United States Patent
Torgov et al.

(10) Patent No.: US 9,968,687 B2
(45) Date of Patent: May 15, 2018

(54) ANTI-DLL3 ANTIBODY DRUG CONJUGATES

(71) Applicants: AbbVie Stemcentrx LLC, North Chicago, IL (US); Medimmune Limited, Cambridge (GB)

(72) Inventors: Michael Torgov, Los Angeles, CA (US); Philip Wilson Howard, London (GB)

(73) Assignees: AbbVie Stemcentrx LLC, North Chicago, IL (US); Medimmune Limited, Cambridge (GB)

( * ) Notice: Subject to any disclaimer, the term of this patent is extended or adjusted under 35 U.S.C. 154(b) by 80 days.

(21) Appl. No.: 14/769,787

(22) PCT Filed: Feb. 21, 2014

(86) PCT No.: PCT/US2014/017810
§ 371 (c)(1),
(2) Date: Aug. 21, 2015

(87) PCT Pub. No.: WO2014/130879
PCT Pub. Date: Aug. 28, 2014

(65) Prior Publication Data
US 2016/0015828 A1 Jan. 21, 2016

Related U.S. Application Data

(60) Provisional application No. 61/768,368, filed on Feb. 22, 2013.

(51) Int. Cl.
| | | |
|---|---|---|
| A61K 39/395 | (2006.01) | |
| C07K 16/18 | (2006.01) | |
| C12P 21/08 | (2006.01) | |
| C07K 16/30 | (2006.01) | |
| A61K 47/48 | (2006.01) | |
| A61K 31/5517 | (2006.01) | |
| A61K 45/06 | (2006.01) | |
| A61K 47/68 | (2017.01) | |

(52) U.S. Cl.
CPC .... *A61K 47/48569* (2013.01); *A61K 31/5517* (2013.01); *A61K 45/06* (2013.01); *A61K 47/6803* (2017.08); *A61K 47/6849* (2017.08); *C07K 16/30* (2013.01); *C07K 16/3023* (2013.01); *C07K 2317/24* (2013.01); *C07K 2317/33* (2013.01); *C07K 2317/34* (2013.01); *C07K 2317/77* (2013.01); *C07K 2317/92* (2013.01)

(58) Field of Classification Search
None
See application file for complete search history.

(56) References Cited

U.S. PATENT DOCUMENTS

| | | |
|---|---|---|
| 4,676,980 A | 6/1987 | Segal et al. |
| 4,816,567 A | 3/1989 | Cabilly et al. |
| 5,112,946 A | 5/1992 | Maione |
| 5,122,368 A | 6/1992 | Greenfield et al. |
| 5,223,409 A | 6/1993 | Ladner et al. |
| 5,336,603 A | 8/1994 | Capon et al. |
| 5,349,053 A | 9/1994 | Landolfi |
| 5,359,046 A | 10/1994 | Capon et al. |
| 5,447,851 A | 9/1995 | Beutler et al. |
| 5,545,806 A | 8/1996 | Lonberg et al. |
| 5,545,807 A | 8/1996 | Surani et al. |
| 5,569,825 A | 10/1996 | Lonberg et al. |
| 5,622,929 A | 4/1997 | Willner et al. |
| 5,625,126 A | 4/1997 | Lonberg et al. |
| 5,633,425 A | 5/1997 | Lonberg et al. |
| 5,661,016 A | 8/1997 | Lonberg et al. |
| 5,693,762 A | 12/1997 | Queen et al. |
| 5,750,373 A | 5/1998 | Garrard et al. |
| 5,824,805 A | 10/1998 | King et al. |
| 6,075,181 A | 6/2000 | Kucherlapati et al. |
| 6,150,584 A | 11/2000 | Kucherlapati et al. |
| 6,180,370 B1 | 1/2001 | Queen et al. |
| 6,214,345 B1 | 4/2001 | Firestone et al. |
| 6,300,064 B1 | 10/2001 | Knappik et al. |
| 6,362,331 B1 | 3/2002 | Kamal et al. |
| 6,982,321 B2 | 1/2006 | Winter |
| 7,049,311 B1 | 5/2006 | Thurston et al. |
| 7,087,409 B2 | 8/2006 | Barbas, III et al. |
| 7,189,710 B2 | 3/2007 | Kamal et al. |
| 7,279,554 B2 | 10/2007 | Chan et al. |
| 7,279,558 B2 | 10/2007 | Ota et al. |
| 7,407,951 B2 | 8/2008 | Thurston et al. |
| 7,422,739 B2 | 9/2008 | Anderson et al. |

(Continued)

FOREIGN PATENT DOCUMENTS

| | | |
|---|---|---|
| EP | 0307434 | 3/1989 |
| EP | 0367166 | 5/1990 |

(Continued)

OTHER PUBLICATIONS

International Preliminary Report on Patentability issued in PCT/US2014/017810 dated Aug. 15, 2015.
Official action dated Oct. 4, 2015, issued in Colombian Patent Application No. 15-223.132.
Official action dated Jan. 20, 2016, issued in Vietnamese Application No. 1-2015-03483.
Extended European Search Report dated Jul. 22, 2016, in European Patent Application No. 14753730.2.
Official action dated Feb. 9, 2017, issued in Saudi Arabian Patent Application No. 515360928.
Accession No. NM_016941; "Homo sapiens delta-like 3 (Drosophila) (DLL3), transcript variant 1, mRNA".
Accession No. NM_203486; "Homo sapiens delta-like 3 (Drosophila) (DLL3), transcript variant 2, mRNA".

(Continued)

*Primary Examiner* — Christine J Saoud
*Assistant Examiner* — Jon M Lockard
(74) *Attorney, Agent, or Firm* — Womble Bond Dickinson (US) LLP

(57) ABSTRACT

Provided are novel antibody drug conjugates (ADCs), and methods of using such ADCs to treat proliferative disorders.

59 Claims, 22 Drawing Sheets

(56) References Cited

U.S. PATENT DOCUMENTS

| | | | |
|---|---|---|---|
| 7,429,658 B2 | 9/2008 | Howard et al. | |
| 7,521,541 B2 | 4/2009 | Eigenbrot et al. | |
| 7,557,099 B2 | 7/2009 | Howard et al. | |
| 7,619,068 B2 | 11/2009 | Pilkington et al. | |
| 7,632,678 B2 | 12/2009 | Hansford et al. | |
| 7,700,302 B2 | 4/2010 | Hua et al. | |
| 7,723,485 B2 | 5/2010 | Junutula et al. | |
| 7,741,319 B2 | 6/2010 | Howard et al. | |
| 7,825,267 B2 | 11/2010 | Koide et al. | |
| 8,029,984 B2 | 10/2011 | Alitalo et al. | |
| 8,034,808 B2 | 10/2011 | Delavault et al. | |
| 8,133,857 B2 | 3/2012 | Aikawa | |
| 8,163,736 B2 | 4/2012 | Gauzy et al. | |
| 8,557,965 B2 | 10/2013 | Saunders et al. | |
| 8,788,213 B2 | 7/2014 | Bright et al. | |
| 9,089,617 B2 * | 7/2015 | Stull | A61K 47/48638 |
| 9,150,664 B2 | 10/2015 | Kufer et al. | |
| 9,683,039 B2 | 6/2017 | Aifantis et al. | |
| 2003/0180784 A1 | 9/2003 | McCarthy et al. | |
| 2004/0101920 A1 | 5/2004 | Radziejewski et al. | |
| 2005/0008625 A1 | 1/2005 | Balint et al. | |
| 2005/0238649 A1 | 10/2005 | Doronina et al. | |
| 2007/0141066 A1 | 6/2007 | Phillips et al. | |
| 2007/0292414 A1 | 12/2007 | Duntsch | |
| 2008/0138313 A1 | 6/2008 | Frankel | |
| 2008/0175870 A1 | 7/2008 | Mather et al. | |
| 2009/0130105 A1 | 5/2009 | Glaser et al. | |
| 2009/0155255 A1 | 6/2009 | Glaser et al. | |
| 2010/0162416 A1 | 6/2010 | Krtolica et al. | |
| 2010/0184021 A1 | 7/2010 | Sella-Tavor et al. | |
| 2010/0273160 A1 | 10/2010 | Donahoe et al. | |
| 2010/0275280 A1 | 10/2010 | Clevers et al. | |
| 2011/0020221 A1 | 1/2011 | Berman et al. | |
| 2011/0256157 A1 | 10/2011 | Howard et al. | |
| 2012/0078028 A1 | 3/2012 | Satpayev et al. | |
| 2012/0328624 A1 | 12/2012 | Yoshida et al. | |
| 2013/0061340 A1 | 3/2013 | Dylla et al. | |
| 2013/0061342 A1 | 3/2013 | Dylla et al. | |
| 2013/0260385 A1 | 10/2013 | Dylla et al. | |
| 2014/0106449 A1 | 4/2014 | June et al. | |
| 2014/0127239 A1 | 5/2014 | Howard | |
| 2014/0363455 A1 | 12/2014 | Stull et al. | |
| 2014/0370037 A1 | 12/2014 | Stull et al. | |
| 2015/0030636 A1 | 1/2015 | Dylla et al. | |

FOREIGN PATENT DOCUMENTS

| | | |
|---|---|---|
| EP | 2530091 A1 | 12/2012 |
| JP | 58180487 | 10/1983 |
| WO | WO 91/00360 | 1/1991 |
| WO | WO 91/06570 | 5/1991 |
| WO | WO 91/17271 | 11/1991 |
| WO | WO 92/00373 | 1/1992 |
| WO | WO 92/01047 | 1/1992 |
| WO | WO 92/09690 | 6/1992 |
| WO | WO 92/15679 | 9/1992 |
| WO | WO 92/18619 | 10/1992 |
| WO | WO 92/20791 | 11/1992 |
| WO | WO 93/01288 | 1/1993 |
| WO | WO 94/04690 | 3/1994 |
| WO | WO 96/04388 | 2/1996 |
| WO | WO 96/07754 | 3/1996 |
| WO | WO 96/27011 | 9/1996 |
| WO | WO 97/33899 | 9/1997 |
| WO | WO 97/34911 | 9/1997 |
| WO | WO 98/52976 | 11/1998 |
| WO | WO 99/23105 | 5/1999 |
| WO | WO 00/34317 | 6/2000 |
| WO | WO 01/12664 | 2/2001 |
| WO | WO 02/14358 | 2/2002 |
| WO | WO 03/048731 | 6/2003 |
| WO | WO 03/075957 | 9/2003 |
| WO | WO 2004/035537 | 4/2004 |
| WO | WO 2006/119062 A2 | 11/2006 |
| WO | WO 2007/080597 A2 | 7/2007 |
| WO | WO 2007/085930 | 8/2007 |
| WO | WO 2007/111733 A2 | 10/2007 |
| WO | WO 2008/047925 A1 | 4/2008 |
| WO | WO 2009/052249 | 4/2009 |
| WO | WO 2009/124931 A2 | 10/2009 |
| WO | WO 2011/093097 A1 | 8/2011 |
| WO | WO 2011/128650 | 10/2011 |
| WO | WO 2011/130598 | 10/2011 |
| WO | WO 2011/130613 | 10/2011 |
| WO | WO 2011/130616 A1 | 10/2011 |
| WO | WO 2012/031280 | 3/2012 |
| WO | WO 2012/128801 | 9/2012 |
| WO | WO 2013/041606 | 3/2013 |
| WO | WO 2013/055987 | 4/2013 |
| WO | WO 2013/119964 | 8/2013 |
| WO | WO 2013/126746 A2 | 8/2013 |
| WO | WO 2014/057072 | 4/2014 |
| WO | WO 2014/057074 | 4/2014 |
| WO | WO 2014/130879 | 8/2014 |
| WO | WO 2015/031693 A1 | 3/2015 |
| WO | WO 2015/031698 | 3/2015 |
| WO | WO 2015/052532 | 4/2015 |
| WO | WO 2015/052533 | 4/2015 |
| WO | WO 2015/052534 | 4/2015 |
| WO | WO 2015/052535 | 4/2015 |
| WO | WO 2015/127407 | 8/2015 |
| WO | WO 2016/064749 | 4/2016 |

OTHER PUBLICATIONS

Accession No. NP_058637; "delta-like protein 3 isoform 1 precursor [*Homo sapiens*]".

Accession No. NP_982353; "delta-like protein 3 isoform 2 precursor [*Homo sapiens*]".

Accession No. Q9NYJ7; RecName: Full=Delta-like protein 3; AltName: Full=Drosophila Delta homolog 3; Short=Delta3; Flags: Precursor [*Homo sapiens*].

Antonow and Thurston, "Synthesis of DNA-interactive pyrrolo[2,1-c][1,4]benzodiazepines (PBDs)." *Chem. Rev.* (2011) 111(4):2815-2864.

Apelqvist A et al. "Notch signalling controls pancreatic cell differentiation". *Nature*, (1999) 400(6747):877-81.

Arima et al, "Studies on tomaymycin, a new antibiotic. I. Isolation and properties of tomaymycin." *J Antibiot (Tokyo)*, (1972) 25(8):437-44.

Ball, "Achaete-scute homolog-1 and Notch in lung neuroendocrine development and cancer," *Cancer Letters*, 2004, 204(2): 159-69.

Bigas A and Espinosa L, "Hematopoietic stem cells: to be or Notch to be." *Blood.* (Apr. 5, 2012) 119(14):3226-35.

Bose et al, "New approaches to pyrrolo[2,1-c][1,4]benzodiazepines: synthesis, DNA-binding and cytotoxicity of DC-81." *Tetrahedron*, (1992) 48:751-58.

Carter P,"Potent antibody therapeutics by design." *Nat Rev Immunol.* (2006) 6(5):343-57.

Chapman G et al., "Notch inhibition by the ligand DELTA-LIKE 3 defines the mechanism of abnormal vertebral segmentation in spondylocostal dysostosis." *Hum Mol Genet.* Mar. 1, 2011; 20(5):905-16.

Chen H et al., "Conservation of the Drosophila lateral inhibition pathway in human lung cancer: a hairy-related protein (HES-1) directly represses achaete-scute homolog-1 expression." *Proc Natl Acad Sci USA* (1997) 94:5355-60. PMID: 9144241.

Cochran et al. "Domain-level antibody epitope mapping through yeast surface display of epidermal growth factor receptor fragments." *J Immunol Methods.* (Apr. 2004) 287(1-2):147-58.

Cook M et al., "Notch in the development of thyroid C-cells and the treatment of medullary thyroid cancer." *Am J Transl Res.* (Feb. 10, 2010) 2(1):119-25.

De La Pompa JL et al, "Conservation of the Notch signaling pathway in mammalian neurogenesis." *Development* (Mar. 1997) 124(6):1139-48.

Dornan et al, "Therapeutic potential of an anti-CD79b antibody-drug conjugate, anti-CD79b-vc-MMAE, for the treatment of non-Hodgkin lymphoma." *Blood.* (2009) 114(13):2721-9.

(56) References Cited

OTHER PUBLICATIONS

Doronina et al, "Enhanced activity of monomethylauristatin F through monoclonal antibody delivery: effects of linker technology on efficacy and toxicity." *Bioconjug Chem*. (2006) 17(1):114-24.
D'Souza Brendan et al."Canonical and non-canonical Notch ligands." *Curr Top Dev Biol*. (2010) 92:73-129.
Dunwoodie SL "The role of Notch in patterning the human vertebral column." *Curr Opin Genet Dev*. (2009) 19(4):329-37.
Dutta S et al., "Notch signaling regulates endocrine cell specification in the zebrafish anterior pituitary." *Dev Biol*. (Jul. 15, 2008) 319(2):248-57.
Dylla et al. "Colorectal cancer stem cells are enriched in xenogeneic tumors following chemotherapy." *PLoS One* (Jun. 18, 2008) 3(6):e2428.
Erickson et al, "Antibody-maytansinoid conjugates are activated in targeted cancer cells by lysosomal degradation and linker-dependent intracellular processing." *Cancer Res*. (2006) 66(8):4426-33.
Fre S et al. "Notch signals control the fate of immature progenitor cells in the intestine." Nature. (Jun. 16, 2005) 435(7044):964-8.
Fre S et al. "Notch and Wnt signals cooperatively control cell proliferation and tumorigenesis in the intestine." *Proc Natl Acad Sci U S A*. (Apr. 14, 2009) 106(15):6309-14.
Galluzzo P, and Bocchetta M "Notch signaling in lung cancer." *Expert Rev Anticancer Ther*. (Apr. 2011) 11(4):533-40.
Geffers I et al., "Divergent functions and distinct localization of the Notch ligands DLL1 and DLL3 in vivo." *J Cell Biol*. (Jul. 30, 2007) 178(3):465-76.
Glittenberg M, et al., "Role of conserved intracellular motifs in Serrate signalling, cis-inhibition and endocytosis." *EMBO J*. (Oct. 18, 2006) 25(20):4697-706. Epub Sep. 28, 2006.
Gregson et al, "Synthesis of a novel C2/C2'-exo unsaturated pyrrolobenzodiazepine cross-linking agent with remarkable DNA binding affinity and cytotoxicity." *Chem. Commun*. (1999) 9:797-798.
Gregson et al, "Design, synthesis, and evaluation of a novel pyrrolobenzodiazepine DNA-interactive agent with highly efficient cross-linking ability and potent cytotoxicity." *J Med Chem*. (2001) 44(5):737-48.
Habener JF et al. "Minireview: transcriptional regulation in pancreatic development." *Endocrinology*. (2005) 146(3):1025-34. Epub Dec. 16, 2004.
Hamann P, "Monoclonal antibody—drug conjugates." *Expert Opin. Ther. Patents*, (2005) 15(9):1087-1103.
Hamblett et al, "Effects of drug loading on the antitumor activity of a monoclonal antibody drug conjugate." *Clin Cancer Res*. (2004) 10(20):7063-70.
Hara et al, "DC 102, a new glycosidic pyrrolo(1,4)benzodiazepine antibiotic produced by Streptomyces sp." *J Antibiot (Tokyo)*. (1988) 41(5):702-4.
Harris PJ et al."Targeting embryonic signaling pathways in cancer therapy." *Expert Opin Ther Targets*. (2012) 16(1):131-45.
Henke RM et al. "Ascl1 and Neurog2 form novel complexes and regulate Delta-like3 (DLL3) expression in the neural tube." *Dev Biol*. (2009) 328(2):529-40.
Hochlowski et al, "Abbeymycin, a new anthramycin-type antibiotic produced by a streptomycete." *J Antibiot (Tokyo)*. (1987) 40(2):145-8.
Hoey et al, "DLL4 blockade inhibits tumor growth and reduces tumor-initiating cell frequency." *Cell Stem Cell*. (2009) 5(2):168-77.
Hoyne GF, et al., "A cell autonomous role for the Notch ligand Delta-like 3 in αβ T-cell development." *Immunol Cell Biol*. (2011) 89(6):696-705.
Huber K et al., "Development of chromaffin cells depends on MASH1 function." *Development*. (2002) 129(20):4729-38.
Hurley and Needham-Vandevanter, "Covalent binding of antitumor antibiotics in the minor groove of DNA. Mechanism of action of CC-1065 and the pyrrolo(1,4)benzodiazepines." *Acc. Chem. Res*. (1986) 19 (8): 230-237.
International Search Report and Written Opinon of the International Searching Authority issued in PCT/US2014/017810 dated Aug. 11, 2014.

Ito T et al., "Basic helix-loop-helix transcription factors regulate the neuroendocrine differentiation of fetal mouse pulmonary epithelium." *Development*. Sep. 2000; 127(18):3913-21.
Itoh et al, "Sibanomicin, a new pyrrolo[1,4]benzodiazepine antitumor antibiotic produced by a Micromonospora sp." *J Antibiot (Tokyo)*. (1988) 41(9):1281-4.
Jeffrey et al, "Design, synthesis, and in vitro evaluation of dipeptide-based antibody minor groove binder conjugates." *J Med Chem*. (2005) 48(5):1344-58.
Junutula et al, "Site-specific conjugation of a cytotoxic drug to an antibody improves the therapeutic index." *Nat Biotechnol*. (2008) 26(8):925-32.
Kameda Y et al., "Mash1 regulates the development of C cells in mouse thyroid glands." *Dev Dyn*. Jan. 2007; 236(1):262-70.
Klein T, et al., "An intrinsic dominant negative activity of serrate that is modulated during wing development in Drosophila." *Dev Biol*. Sep. 1, 1997; 189(1):123-34.
Klimstra DS, et al., "The pathologic classification of neuroendocrine tumors: a review of nomenclature, grading, and staging systems." *Pancreas*. Aug. 2010;39(6):707-12.
Klöppel G. "Classification and pathology of gastroenteropancreatic neuroendocrine neoplasms. Endocr Relat Cancer." *Endocr Relat Cancer*. (2011) 18 Suppl 1:S1-16.
Koch U and Radtke,F. "Notch signaling in solid tumors." *Curr Top Dev Biol*. (2010) 92:411-55.
Kohn, "Anthramycin," In *Antibiotics III*. Springer-Verlag, New York, pp. 3-11 (1975).
Konishi et al, "Chicamycin, a new antitumor antibiotic. II. Structure determination of chicamycins A and B." *J Antibiot (Tokyo)*. (1984) 37(3):200-6.
Kovtun et al, "Antibody-drug conjugates designed to eradicate tumors with homogeneous and heterogeneous expression of the target antigen." *Cancer Res*. (2006) 66(6):3214-21.
Kunimoto et al, "Mazethramycin, a new member of anthramycin group antibiotics." *J Antibiot (Tokyo)*. (1980) 33(6):665-7.
Ladi E et al. "The divergent DSL ligand Dll3 does not activate Notch signaling but cell autonomously attenuates signaling induced by other DSL ligands." *J Cell Biol*. (2005) 170(6):983-92.
Lambert J, et al, "Drug-conjugated monoclonal antibodies for the treatment of cancer." *Curr Opin Pharmacol*. (2005) 5(5):543-9.
Langley and Thurston, "A versatile and efficient synthesis of carbinolamine-containing pyrrolo[1,4]benzodiazepines via the cyclization of N-(2-aminobenzoyl)pyrrolidine-2-carboxaldehyde diethyl thioacetals: total synthesis of prothracarcin." *J Org Chem*. (1987) 52, 91-97.
Law et al, "Lymphocyte activation antigen CD70 expressed by renal cell carcinoma is a potential therapeutic target for anti-CD70 antibody-drug conjugates." *Cancer Res*. (2006) 66(4):2328-37.
Leber et al, "A revised structure of sibiromycin." *J. Am. Chem. Soc*., (1988) 110 (9):2992-2993.
Leimgruber et al, "Isolation and characterization of anthramycin, a new antitumor antibiotic." *J. Am. Chem. Soc*. (1965) 87(24): 5791-93.
Leimgruber et al, "The structure of anthramycin." *J. Am. Chem. Soc*. (1965) 87(24):5793-95.
Liu J et al., "Notch signaling in the regulation of stem cell self-renewal and differentiation." *Curr Top Dev Biol*. (2010) 92:367-409.
McDonagh et al, "Engineered antibody-drug conjugates with defined sites and stoichiometries of drug attachment." *Protein Eng Des Sel*. (2006) 19(7):299-307.
Millipore "Anti-Delta3, clone 1E7.2", Jul. 15, 2008, pp. 1-3 (XP002697359).
Nagase H et al. "γ-Secretase-regulated signaling pathways, such as notch signaling, mediate the differentiation of hematopoietic stem cells, development of the immune system, and peripheral immune responses." *Curr Stem Cell Res Ther*. (2011)6(2):131-41.
Payne G, "Progress in immunoconjugate cancer therapeutics." *Cancer Cell*. (2003) 3(3):207-12.
R&D Systems: "Human DLL3 Antibody Monoclonal Mouse IgG2B Clone #378703, Catalog No. MA4315" (May 5, 2010) pp. 1-1, (XP002697358).

(56) References Cited

OTHER PUBLICATIONS

Raetzman LT et al., "Developmental regulation of Notch signaling genes in the embryonic pituitary: Prop1 deficiency affects Notch2 expression." *Dev Biol.* (2004) 265(2):329-40.
Rebay I, et al., "Specific EGF repeats of Notch mediate interactions with Delta and Serrate: implications for Notch as a multifunctional receptor." *Cell.* (Nov. 15, 1991) 67(4):687-99.
Sakamoto K et al., "Intracellular cell-autonomous association of Notch and its ligands: a novel mechanism of Notch signal modification." *Dev Biol.* Jan. 15, 2002; 241(2):313-26. PMID: 11784114.
Sanderson et al, "In vivo drug-linker stability of an anti-CD30 dipeptide-linked auristatin immunoconjugate." *Clin Cancer Res.* (2005) 11(2 Pt 1):843-52.
Schonhoff SE et al. "Minireview: Development and differentiation of gut endocrine cells." *Endocrinology.* Jun. 2004; 145(6):2639-44.
Schulenburg et al. "Neoplastic stem cells: current concepts and clinical perspectives." *Crit Rev Oncol Hematol.* Nov. 2010; 76(2):79-98.
Shimizu et al, "Prothracarcin, A novel antitumor antibiotic." *J Antibiotics,* (1982) 29:2492-2503.
Shimizu K et al. "Mouse jagged1 physically interacts with notch2 and other notch receptors. Assessment by quantitative methods." *J Biol Chem.* (Nov. 12, 1999) 274(46):32961-9.
Sprinzak D et al. "Cis-interactions between Notch and Delta generate mutually exclusive signalling states." *Nature.* May 6, 2010;465(7294):86-90.
Sriuranpong V et al. "Notch signaling induces rapid degradation of achaete-scute homolog 1." *Mol Cell Biol.* (2002) 22(9):3129-39.
Sternberg PW, "Lateral inhibition during vulval induction in Caenorhabditis elegans." *Nature* (1988) 335(6190):551-4.
Syrigos and Epenetos, 37 Antibody directed enzyme prodrug therapy (ADEPT): a review of the experimental and clinical considerationsAnticancer Res. (1999) 19(1A):605-13.
Takeuchi et al, "Neothramycins A and B, new antitumor antibiotics." *J Antibiot (Tokyo).* (1976) 29(1):93-6.
Thurston et al, "The Molecular Recognition of DNA." *CHEM. BRIT.* (1990) 26:767-772.
Thruston et al, "Synthesis of DNA-Interactive Pyrrolo[2,1-c][1,4]benzodiazepines." *Chem. Rev.* (1994) 94(2):433-465.
Trail et al, "Monoclonal antibody drug immunoconjugates for targeted treatment of cancer." *Cancer Immunol Immunother.* (2003) 52(5):328-37.
Tsunakawa et al, "Porothramycin, a new antibiotic of the anthramycin group: production, isolation, structure and biological activity." *J Antibiot (Tokyo).* (1988) 41(10):1366-73.
Visvader et al, "Cancer stem cells in solid tumours: accumulating evidence and unresolved questions." *Nat Rev Cancer.* (Oct. 2008) 8(10):755-68.
Wharton KA, et al., "Nucleotide sequence from the neurogenic locus notch implies a gene product that shares homology with proteins containing EGF-like repeats." *Cell.* Dec. 1985;43(3 Pt 2):567-81.
Wu et al, "Arming antibodies: prospects and challenges for immunoconjugates." *Nat Biotechnol.* (2005) 23(9):1137-46.
Xie et al, "In vivo behaviour of antibody-drug conjugates for the targeted treatment of cancer." *Expert Opin Biol Ther.* (2006) 6(3):281-91.
Yao JC et al. "One hundred years after "carcinoid": epidemiology of and prognostic factors for neuroendocrine tumors in 35,825 cases in the United States." *J Clin Oncol.* (Jun. 20, 2008) 26:3063-72.
Zarebczan B, Chen H "Signaling mechanisms in neuroendocrine tumors as targets for therapy." *Endocrinol Metab Clin North Am.* (2010) 39(4):801-10.
DLL3 Aptamer Presentation, "Aptamer Technology for Cell-Specific Cancer Therapy," (Jul. 7 2010) Academia Sinica.
ADC Review: "Rovalpituzumab tesirine / Rova-T / SC16LD6.5 Drug Description," http://adcreview.com Feb. 27, 2016 Retrieved from the Internet: URL:http://adcreview.com/sc161d6-5-drug-description/ [retrieved on Feb. 21, 2017].

Ashkenazi et al., "Protection against endotoxic shock by a tumor necrosis factor receptor immunoadhesin," *Proc Natl Acad Sci USA* (Dec. 1, 1991) 88(23):10535-9.
Ayyanan, A., et al., "Increased Wnt signaling triggers oncogenic conversion of human breast epithelial cells by Notch-dependent mechanism," *Natl Acad Sci USA* (2006) 103(10): 3799-3804.
Barabas et al., "Assembly of combinatorial antibody libraries on phage surfaces: the gene III site," *Proc. Natl. Acad. Sci. USA* (1991) 88:7978-7982.
Boerner et al.,"Production of antigen-specific human monoclonal antibodies from in vitro-primed human splenocytes," *J Immunol.* (Jul. 1, 1991) 147(1):86-95—ABSTRACT.
Boswell et al., "An integrated approach to identify normal tissue expression of targets for antibody-drug conjugates: case study of TENB2," *British Journal of Pharmacology* (2013) 168:445-457.
Chothia et al., "Canonical structures for the hypervariable regions of immunoglobulins," *J Mol Biol.* (Aug. 20, 1987) 196(4):901-17.
Chothia et al., "Conformations of immunoglobulin hypervariable regions," *Nature* (Dec. 21-28, 1989) 342(6252):877-83.
Chothia, D., et al., "Structural repertoire of the human VH segments," *J Mol Biol.* (Oct. 5, 1992) 227(3):799-817—ABSTRACT.
Cook, G. P., et al., "The human immunoglobulin VH repertoire," *Immunol Today* (May 1995) 16(5):237-42—ABSTRACT.
Denardo et al., "Comparison of 1,4,7,10-tetraazacyclododecane-N,N',N",N'''-tetraacetic acid (DOTH)-peptide-ChL6, a novel immunoconjugate with catabolizable linker, to 2-iminothiolane-2-[p-(bromoacetamido)benzyl]-DOTA-ChL6 in breast cancer xenografts," *Clin Cancer Res.* (Oct. 1998) 4(10):2483-90.
Dubowchik et al., "Cathepsin B-labile dipeptide linkers for lysosomal release of doxorubicin from internalizing immunoconjugates: model studies of enzymatic drug release and antigen-specific in vitro anticancer activity," *Bioconjug Chem.* (Jul.-Aug. 2002) 13(4):855-69—ABSTRACT.
Dunwoodie et al., "Mouse DLL3: a novel divergent Delta gene which may complement the function of other Delta homologues during early pattern formation in the mouse embryo," *Development* (Aug. 1997) 124(16):3065-76.
Fuhrmann, S., et al., "Abstract 5625: In vitro and in vivo pharmacology of MEDI-565 (MT111), a novel CEA/CD3-bispecific single-chain BiTE antibody in development for the treatment of gastrointestinal adenocarcinomas," *Cancer Research* (Apr. 15, 2010) vol. 70, Issue 8, Supplement 1.
Garnett, M.C., "Targeted drug conjugates: principles and progress," *Adv Drug Deliv Rev.* (Dec. 17, 2001) 53(2):171-216.
Goldbeter, A., and Pourquié, O., "Modeling the segmentation clock as a network of coupled oscillations in the Notch, Wnt and FGF signaling pathways," *J Theor Biol.* (Jun. 7, 2008) 252(3):574-85.; PMID: 18308339.
Hochleitner et al., "Characterization of a discontinuous epitope of the human immunodeficiency virus (HIV) core protein p24 by epitope excision and differential chemical modification followed by mass spectrometric peptide mapping analysis," *Protein Sci.* (Mar. 2000) 9(3):487-96.
Huff, Carol Ann et al. "Strategies to eliminate cancer stem cells: Clinical implications," *European Journal of Cancer* 42 (2006) 1293-1297.
Jensen, J., et al., "Control of endodermal endocrine development by Hes-1," *Nat Genet.* (Jan. 2000) 24(1):36-44 PMID: 10615124.
Jones et al., "Replacing the complementarity-determining regions in a human antibody with those from a mouse," *Nature* (May 29-Jun. 4, 1986) 321(6069):522-5—ABSTRACT.
Kageyama, R., et al., "Oscillator mechanism of Notch pathway in the segmentation clock," *Dev Dyn.* (Jun. 2007) 236(6):1403-9 PMID:17366573.
Kroesen, BJ, et al., "Approaches to lung cancer treatment using the CD3 x EGP-2-directed bispecific monoclonal antibody BIS-1," *Cancer Immunol Immunother.* (Nov.-Dec. 1997) 45(3-4):203-6.
Kusumi, K., et al., "The mouse pudgy mutation disrupts Delta homologue DLL3 and initiation of early somite boundaries," *Nat Genet.* (Jul. 1998) 19(3):274-8 PMID: 9662403.
Lonberg et al., "Human antibodies from transgenic mice," *Int Rev Immunol.* (1995) 13(1):65-93—ABSTRACT.

(56) References Cited

OTHER PUBLICATIONS

MacCallum et al., "Antibody-antigen interactions: contact analysis and binding site topography," *J Mol Biol.* (Oct. 11, 1996) 262(5):732-45.

Maemura, Kentaro, et al., "Delta-like 3 is silenced by methylation and induces apoptosisin human hepatocellular carcinoma," *Int J Oncol.* (Mar. 2013) 42(3): 817-822.

Marks et al., "By-passing immunization: building high affinity human antibodies by chain shuffling," *Biotechnology (N Y)* (Jul. 1992) 10(7):779-783—ABSTRACT.

Milstein et al., "Hybridomas and their use in immunohistochemistry," *Nature* (1983) 305:537-539—ABSTRACT.

Morrison et al., "Chimeric human antibody molecules: mouse antigen-binding domains with human constant region domains," *Proc Natl Acad Sci USA* (Nov. 1984) 81(21):6851-5.

Peterson et al., "Enzymatic cleavage of peptide-linked radiolabels from immunoconjugates," *Bioconjug Chem.* (Jul.-Aug. 1999) 10(4):553-7.

Reineke, U., "Antibody epitope mapping using arrays of synthetic peptides," *Methods Mol Biol.* (2004) 248:443-63.

Retter et al., "VBASE2, an integrative V gene database," *Nucleic Acids Res.* (Jan. 1, 2005) 33 (Database issue):D671-4.

Robine, S., et al., "Notch signals control the fate of immature progenitor cells in the intestine," *Med Sci* (Paris) (Aug.-Sep. 2005) 21(8-9):780-2.

Roitt I., et al., *Immunology*, Moscow, Mir (2000) 592 pages, pp. 110-111.

Saunders et al., "A DLL3-targeted antibody-drug conjugate eradicates high-grade pulmonary neuroendocrine tumor-initiating cells in vivo," *Sci Transl Med.* (Aug. 26, 2015) 7(302):302ra136. doi: 10.1126/scitranslmed.aac9459.

Schalper et al., "Programmed death-1/programmed death-1 ligand axis as a therapeutic target in oncology: current insights," *Journal of Receptor, Ligand and Channel Research ePub* (Dec. 23, 2014) 8:1-7.

Schildbach, J.F., et al., "Modulation of antibody affinity by a non-contact residue," *Protein Sci* (1993) 2:206-214.

Sebastian, Martin, et al., "Treatment of non-small cell lung cancer patients with the trifunctional monoclonal antibody catumaxomab (anti-EpCAM x anti-CD3): a phase I study," *Cancer Immunol Immunother.* (Oct. 2007) 56(10):1637-44. Epub Apr. 5, 2007.

Sheets et al., "Efficient construction of a large nonimmune phage antibody library: the production of high-affinity human single-chain antibodies to protein antigens," *Proc Natl Acad Sci USA* (May 26, 1998) 95(11):6157-62.

Shinkai Y et al., "New mutant mouse with skeletal deformities caused by mutation in delta like 3 (DLL3) gene," *Exp Anim.* (Apr. 2004) 53(2):129-36 PMID: 15153675.

Spigel et al., "Rationale for chemotherapy, immunotherapy, and checkpoint blockade in SCLC: beyond traditional treatment approaches," *J Thorac Oncol.* (May 2013) 8(5):587-98. doi: 10.1097/JTO.0b013e318286cf88.

Takahashi et al., "Human Fas ligand: gene structure, chromosomal location and species specificity," International Immunology, (1994) 6(10):1567-1574 PMID 7826947.

Tomlinson et al., "The repertoire of human germline VH sequences reveals about fifty groups of VH segments with different hypervariable loops," *Mol Biol.* (Oct. 5, 1992) 227(3):776-98—ABSTRACT.

Tomlinson et al., "The structural repertoire of the human V kappa domain," *EMBO J.* (Sep. 15, 1995) 14(18):4628-38.

Turnpenny, P.D., et al., "A gene for autosomal recessive spondylocostal dysostosis maps to 19q13.1-q13.3," *Am J Hum Genet.* (Jul. 1999) 65(1):175-82.

Vaughan et al., "Human antibodies with sub-nanomolar affinities isolated from a large non-immunized phage display library," *Nature Biotechnol.* (Mar. 1996) 14(3):309-14—ABSTRACT.

Vié et al., "Human fusion proteins between interleukin 2 and IgM heavy chain are cytotoxic for cells expressing the interleukin 2 receptor," *Proc Natl Acad Sci USA* (Dec. 1, 1992) 89(23):11337-41.

XP-002767506, "Phase I/II Open Label Dose Escalation Study of the Safety, Pharmacokinetics, and Preliminary Efficacy of SC16LD6.5 as a Single Agent in Patients With Recurrent Small Cell Lung Cancer," Clinical Trials.gov archive, URL:https://clinicaltrials.gov/archive/NCT01901653/2013_08_20 (Aug. 20, 2013).

Zheng et al., "Administration of noncytolytic IL-10/Fc in murine models of lipoolysaccharide-induced septic shock and allogeneic islet transplantation," *J Immunol.* (May 15, 1995) 154(10):5590-600.

Zhou, Bin-Bing S. et al. "Tumour-initiating cells: challenges and opportunities for anticancer drug discovery," *Nat Rev Drug Discov.* (Oct. 2009) 8(10):806-23.

Zimmerman et al., "A triglycine linker improves tumor uptake and biodistributions of 67-Cu-labeled anti-neuroblastoma MAb chCE7 F(ab')2 fragments," *Nucl Med Biol.* (Nov. 1999) 26(8):943-50.

Official action dated Aug. 15, 2017, in Colombian patent application (No. 15-223.132).

Official action dated Oct. 10, 2017, issued in European patent application (No. 14753730.2).

* cited by examiner

Alignment of Two Human DLL3 Isoforms (NP_058637 = var 1; NP_928353 = var 2)

```
                    1                                                                               80
NP_058637     (1)   MVSPRMSGLLSQTVILALIFLPQTRPAGVFELQIHSFGPGPGPGAPRSPCSARLPCRLFFRVCLKPGLSEEAAESPCALG
NP_982353     (1)   MVSPRMSGLLSQTVILALIFLPQTRPAGVFELQIHSFGPGPGPGAPRSPCSARLPCRLFFRVCLKPGLSEEAAESPCALG 81                                                                              160
NP_058637    (81)   AALSARGPVYTEQPGAPAPDLPLPDGLLQVPFRDAWPGTFSFIIETWREELGDQIGGPAWSLLARVAGRRRLAAGGPWAR
NP_982353    (81)   AALSARGPVYTEQPGAPAPDLPLPDGLLQVPFRDAWPGTFSFIIETWREELGDQIGGPAWSLLARVAGRRRLAAGGPWAR 161                                                                             240
NP_058637   (161)   DIQRAGAWELRFSYRARCEPPAVGTACTRLCRPRSAPSRCGPGLRPCAPLEDECEAPLVCRAGCSPEHGFCEQPGECRCL
NP_982353   (161)   DIQRAGAWELRFSYRARCEPPAVGTACTRLCRPRSAPSRCGPGLRPCAPLEDECEAPLVCRAGCSPEHGFCEQPGECRCL 241                                                                             320
NP_058637   (241)   EGWTGPLCTVPVSTSSCLSPRGPSSATTGCLVPGPGPCDGNPCANGGSCSETPRSFECTCPRGFYGLRCEVSGVTCADGP
NP_982353   (241)   EGWTGPLCTVPVSTSSCLSPRGPSSATTGCLVPGPGPCDGNPCANGGSCSETPRSFECTCPRGFYGLRCEVSGVTCADGP 321                                                                             400
NP_058637   (321)   CFNGGLCVGGADPDSAYICHCPPGFQGSNCEKRVDRCSLQPCRNGGLCLDLGHALRCRCRAGFAGPRCEHDLDDCAGRAC
NP_982353   (321)   CFNGGLCVGGADPDSAYICHCPPGFQGSNCEKRVDRCSLQPCRNGGLCLDLGHALRCRCRAGFAGPRCEHDLDDCAGRAC 401                                                                             480
NP_058637   (401)   ANGGTCVEGGGAHRCSCALGFGGRDCRERADPCAARPCAHGGRCYAHFSGLVCACAPGYMGARCEFPVHPDGASALPAAP
NP_982353   (401)   ANGGTCVEGGGAHRCSCALGFGGRDCRERADPCAARPCAHGGRCYAHFSGLVCACAPGYMGARCEFPVHPDGASALPAAP 481                                                                             560
NP_058637   (481)   PGLRPGDPQRYLLPPALGLLVAAGVAGAALLLVHVRRRGHSQDAGSRLLAGTPEPSVHALPDALNNLRTQEGSGDGPSSS
NP_982353   (481)   PGLRPGDPQRYLLPPALGLLVAAGVAGAALLLVHVRRRGHSQDAGSRLLAGTPEPSVHALPDALNNLRTQEGSGDGPSSS 561                       618
NP_058637   (561)   VDWNRPEDVDPQGIYVISAPSIYAREVATPLFPPLHTGRAGQRQHLLFPYPSSILSVK      SEQ ID NO. 1
NP_982353   (561)   VDWNRPEDVDPQGIYVISAPSIYAREA------------------------------      SEQ ID NO. 2
```

FIG. 1

Amino Acid Sequences of Exemplary Murine anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.3 | QIVLTQSPAIMSVSLGERVTMTC | TASSSVSSSYLH | WYQQKPGSSPKLWIY | STSNLAS | GVPARFSGSGSGTSYFTISSMEAEDAATYYC | HQYHRSPFT | FGAGTKLEIR | 21 |
| SC16.4 | DIQMTQTTSSLSASLGDRVTISC | RASQDISNYLN | WYQQKPDGTVKLLIY | YTSRLHS | GVPSRFSGSGSGTDYSLTISNLELEDIATYFC | QQGDMLPWT | FGGGTKLEIK | 25 |
| SC16.5 | QIVLTQSPAIMSASPGEKVTMTC | SASSSVSYMH | WYQQKSGTSPKRWIY | DTSKLAS | GVPARFSGSGSGTSYSLTISSMEAEDAATYYC | QQWTRNPLT | FGAGTKLEIK | 29 |
| SC16.7 | NIMMTQSPSSLAVSAGEKVTMSC | KSSQSVLYSSNQKNYLA | WYQQKPGQSPKLLIY | WASTRES | GVPDRFTGSGSGTDFTLTISTVQVEDLAVYYC | HQYLSSWT | FGGGTKLEIK | 33 |
| SC16.8 | EIQMTQSPSSMSASLGDRITITC | QATQDIVKNLN | WYQQKPGKPPSFLIY | YAIELAE | GVPSRFSGSGSGSDYSLTISNLESEDFADYYC | LQFYEPPFT | FGAGTKLELK | 37 |
| SC16.10 | QIVLTQSPAIMSASLGERVTMTC | TASSSVSSSYLH | WYQQKPGSSPKLWIY | STSNLAS | GVPTRFSGSGSGTSYSLTISSMEAEDAATYYC | HQYHRSPFT | FGSGTKLEIK | 41 |
| SC16.11 | DVEMTQTPLTLSVTIGQPASISC | KSSQSLSDSDGKTYLN | WMFQRPGRSPKRLIY | LVSKLDS | GVPDRFTGSGSGTDFTLKISRVEAEDLGVVYC | WQGKHFPWT | FGGGTKLEIK | 45 |
| SC16.13 | QIVLTQSPALVSASPGEKVTMTC | SASSSVSYMY | WYQQKPRSSPKPWIY | LTSNLAS | GVPARFSGSGSGTSYSLTISSMEAEDAATYYC | QQWRSNPFT | FGSGTKLEIK | 49 |
| SC16.15 | DIQMTQSPASLAASVGETVAITC | RASENIYYNLA | WYQQKQGKSPQLLIY | TANSLED | GVPSRFSGSGSGTQYSLKINSMQPEDSATYFC | KQAYDVPPT | FGGGTKLEIK | 53 |
| SC16.18 | DIQMTQTTSSLSASLGDRVTISC | RASQNIINYLN | WYQQKPDGTVKLLIY | YTSRLHS | GVPSRFSGSGSGTDYSLTISNLEPEDIATYYC | QQYSERPYT | FGGGTKLEIK | 57 |
| SC16.19 | DIQMTQSPSSLSASLGGKVTFTC | KASQDIHKYVA | WYQHKPGKGPRLLIH | YTSTLQP | GISSRFSGSGSGRDYSFSISNLEPEDIATYYC | LQYNNLYT | FGGGTKLEIK | 61 |
| SC16.20 | EIQMTQSPSSMSASLGDRITITC | QATQDIVKNLN | WYQQKPGKPPSFLIY | YATELAE | GVPSRFSGSGSGSDYSLTIRNLESEDFADHYC | LQFYEPPFT | FGAGTKLELK | 65 |
| SC16.21 | DIVMTQSPSSLAMSVGQKVTMSC | KSSQESLLNESSNQKNYLA | WYQQEPGQGSPKLLVS | FASTRES | GVPDRFTGSGSGTDFTLTISGVQAEDLAVYYC | QQHYSIPLT | FGAGTKLELK | 69 |
| SC16.22 | DIQMTQTTSSLSASLGDRVTISC | RASQDIKNYLN | WYQQKPDGTVKPLIY | YTSRVHS | GVPSRFSGSGSGTDYSLTISNLEQEDIATYFC | QQGYTLPFT | FGSGTKLEIK | 73 |
| SC16.23 | QIVLTQSPAIMSASPGEKVTLTC | SASSSVSRYLY | WYQQKPGSSPKLWIY | STSNLAS | GVPARFSGSGSGTSYLIISSMEAEDAASYFC | HQWSNVPLT | FGAGTKLELK | 77 |
| SC16.25 | QIVLTQSPAIMSASPGEKVTMTC | SASSSVSYMH | WYQQKSGTSPKRWIY | DSSKLAS | GVPARFSGSGSGTSYSLTISSMEAEDAATYYC | QQWSSNPLT | FGAGTKLELK | 81 |
| SC16.26 | DVEMTQTPLTLSVTIGQPASISC | KSSQSLSDSDGKTYLN | WMFQRPGRSPKRLIY | LVSKLDS | GVPDRFTGSGSGTDFTLKISRVEAEDLGVVYC | WQGKHFPWT | FGGGTKLEIK | 85 |
| SC16.29 | QIVLTQSPAIMSASPGEKVTITC | SASSSVSYMH | WFQQKPGTSPKLWIY | TTSNLAS | GVPARFSGSGSGTSYSLTVSRMEAEDAATYYC | QQRSLYPYT | FGGGTKVEIK | 89 |
| SC16.30 | QIVLTQSPTIMSASLGERVTMTC | TASSSVTSSYLH | WYQQKPGSSPKLWIY | STSNLAS | GVPARFSGSGSGTSYSLTISSMEAEDAATYYC | HQFHRSPFT | FGSGTKLEIK | 93 |
| SC16.31 | DIVLTQSPLSLPVNGDQASISC | KSTKSLLNSDGFTYLD | WYLQRPGQSPQFLIY | LVSNRFS | GVPDRFSGSGSGTDFTLKISRVEAEDLGVYYC | FQSNYLPLT | FGAGTKLELR | 97 |

FIG. 3A

Amino Acid Sequences of Exemplary Murine anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.34 | SIVMTQTPKFLLVSAGDRVTITC | KASQSVSNDVA | WYQQKPGQSPKLLIY | YASNRYS | GVPDRFTGSGYGTDFTFTISTVQAEDLAVYFC | QQDYSSPWT | FGGGTKLEIK | 101 |
| SC16.35 | DIQMTQTTSSLSASLGDRVTISC | RASQDISNYLN | WYQQKPDGTVKLLIY | YTSRLHS | GVPSRFSGSGSGTDYSLTISNLEDEDIATYFC | QQGNTLPYT | FGGGTKLEIK | 105 |
| SC16.36 | ETTVTQSPASLSVTTGEKVTIRC | ITTPDIDDDMN | WYQQKPGEPPNLLIS | EGNSLRP | GVPSRFSSSGYGTNPVFTIENTLSEDVADYFC | LQSDNMPFT | FGSGTKLEIK | 109 |
| SC16.38 | QIVLTQSPAIMSASPGEKVTMTC | SASSSINYMH | WYQQKPGTSPKRWIY | DTSKLAS | GVPARFSGSGSGTSYSLTISSMEAEDAATYYC | HQRSTWT | FGGGTKLEIK | 113 |
| SC16.41 | DIQMTQTTSSLSASLGDRVTISC | RASQDVINYLN | WYQQKPDGTVKLLIY | YTSRLHS | GVPSRFSGSGSRTDYSLTISNLEPEDIATYYC | QQYSERPYT | FGGGTKLEIK | 117 |
| SC16.42 | DVLMTQSPLSLSVLGDQASISC | RSSQNIWHSDRYTYLE | WYLQKPGQSPKLLIY | GVSNRFS | GVPDRFSGSGSGTDFTLKISRVEAEDMGVYYC | FQGTHVPYT | FGGGTKLEIK | 121 |
| SC16.45 | EIQMTQSPSSMSASLGDRITITC | QATQDIVKNLN | WYQQKPGKPPSFLIY | YATELAE | GVPARFSGSGSGSDYSLTISNLESEDFADYHC | LQFEFPFT | FGAGTKLELK | 125 |
| SC16.47 | DVVLTQSPLSLPVNIGDQASISC | KSTKSLLNSDGFTYLD | WYLQRPGQSPQFLIY | LVSNRFS | GVPDRFSGSGSGTDFTLKISRVEAEDLGVVYC | FQSNVLPLT | FGAGTKLELR | 129 |
| SC16.49 | DIKMTQSPSSMYASLGERVTITC | KASQDINSYLS | WFQQKPGKSPKTLIY | RANRLVD | GVPSRFSGSGSGQDYSLTITSLEYEDMGIYYC | LQYDEFPLT | FGAGTKLELK | 133 |
| SC16.50 | DIQMTQTTSSLSASLGDRVTISC | RASQDISNYLN | WYQQKPDGTVKLLIY | YTSRLHS | GVPSRFSGSGSGTDYSLTISNLECEDIATYFC | QQGNTLRT | FGGGTKLEIK | 137 |
| SC16.52 | DIQMIQSPSSMFASLGDRVSLSC | RASQGIRGTLD | WYQQKPNGTIKLLIY | STSNLNS | GVPSRFSGSGSGSDYSLTISLESEDFADYYC | LQRNAYPLT | FGAGTKLEIK | 141 |
| SC16.55 | DIKMTQSPSSMYASLGERVTITC | KASQDINSYLN | WFQQKPGKSPKTLIY | RANRLVD | GVPSRFSGSGSGQDYSLTISSLEYEDMGIYYC | LQYDEFPYT | FGGGTKLELK | 145 |
| SC16.56 | SIVMTQTPKFLLVSAGDRVTITC | KASQSVSNDVV | WYQQKPGQSPKLLIY | YASNRYT | GVPDRFAGSGYGTDFSFTISTVQAEDLAVYFC | QQDYTSPWT | FGGGTKLEIR | 149 |
| SC16.57 | DIVMTQSHKFMSVSGDRVSITC | KASQDVSIFVA | WYQQKPGGSPKLLIY | SASYRYT | GVPDRFTGSGSGTDHFTTSSVQAEDLAVYYC | QQHYGTPFT | FGSGTKLKIR | 153 |
| SC16.58 | DIQMTQSPASLSSSVGETVTITC | RASENIYSYLA | WYQQKQGKSPQLLVY | NAKTLAE | GVPSRFSGSGSGTQFSLKINSLQPEDFGTIYYC | QHHYDSPLT | FGAGTKLELR | 157 |
| SC16.61 | DIVMTQSTSSLAMSVGQKVTMSC | KSSQSLLNSSNQKNYLA | WYQQKPGQGSPKLLVS | FASTRES | GVPDRFTGSGSGTDFTLTISGVQAEDLAVYYC | QQHYSIPLT | FGAGTKLELK | 161 |
| SC16.62 | DIKMTQSPSSMYASLGERVTITC | KASQDINSFLS | WFQRKPGKSPKTLIY | RANRLVD | GVPSRFTGSGSGQEFSLTISLEYEDLGIYYC | LQYDEFPYT | FGGGTKLEIK | 165 |
| SC16.63 | QIVLTQSPAIMSASPGEKVTMTC | SASSSVSYMY | WYQQKSGTSPKRWIY | DTSKLAS | GVPARFSGSGSGTSYSLTISSMEAEDAATYYC | QQWSSNPYT | FGGGTKLEIK | 169 |
| SC16.65 | QIVLTQSPALMSASPGEKVTMTC | SVTSSVSYMY | WYQQKPRSSPKPWIY | LTSNLAS | GVPARFSGSGSGTYSLTISVEAEDAATYYC | QQWRNNPFT | FGSGTKVEIK | 173 |
| SC16.67 | QAVVTQESALTTSPGETVTLTC | RSSTGAVTTSNYAN | WIQEKPDHLFTGLIG | GTNNRAP | GVPARFSGSLIGDKAALTITGAQTEDEAIYFC | GLWYSNHLV | FGGGTKLTVL | 177 |
| SC16.68 | ETTVTQSPAELSVATGEKVTIRC | ITSTDIDDDMN | WYQQKPGEPPNVLIS | EGNTLRP | GVPSRFSGSGYGTDFVFTIENTLSEDVADYYC | LQSDNMPLT | FGAGTKLELK | 181 |
| SC16.72 | ENVLTQSPAIMSASLGERVTMSC | RASSSVNYMS | WYQQKSDASPKLWIY | YTSNLAP | GVPARFSGSGSGNSYSLTISSMEGEDAATYYC | QQFTSSPYT | FGGGTKLEIK | 185 |

FIG. 3A cont.

Amino Acid Sequences of Exemplary Murine anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.73 | DIQMTQSPSSLSASLGERVSLTC | RASQDIGYSLN | WLQQEPDGTIKRLIY | ATSSLDS | GVPKRFSGSRSGSDYSLTISSLESEDFVDYYC | LQYASSPWT | FGGGTKLEIK | 189 |
| SC16.78 | DIKMTQSPSSMYASLGERVTITC | KASQDINSYLS | WFQQKPGRSPKTLIY | RANRLVD | GVPSRFSGSGSGQDYSLTISSLDYEDMGIYYC | LQYDEFPFT | FGSGTKLEIK | 193 |
| SC16.79 | DIVMSQSPSSLAVSAGEKVTMSC | KSSQSLLNSRTRKNYLA | WYQQKPGQSPKLUY | WASTRES | GVPDRFTGSGSGTDFTLTISSVQAEDLAVYC | KQSYNLYT | FGGGTKLKIK | 197 |
| SC16.80 | ETTVTQSPASLSMAIGEKVTIRC | ITSTDIDDDMI | WYQQKPGEPPKLLIS | EGNTLRP | GVPSRFSSGYGTDFVFTIENMLSEDVADYYC | LKRDDLPYT | FGGGTQVEIK | 201 |
| SC16.81 | QIVLTQSPAIMSASJGERVTLTC | TASSVSSSYLH | WYQAKPGSSPKLWIY | STSNLAS | GVPTRFSGSGSGTSYSLRISSMEAEDAATYYC | HQYNRSPLT | FGAGTKLELK | 205 |
| SC16.84 | DIQMTQSPSSLSASLGGKVTITC | KASQDIKKYIA | WYQHKPGKGPRLUH | YTSTLEP | GIPSRFSGSGSGRDYSFSISNLEPEDIATYYC | LQYDILWT | FGGGTKLEIK | 209 |
| SC16.88 | ENVLTQSPAIMAASLGQKVTMTC | SASSSVSSSYLH | WYQQKSGASPKPLIH | RTSNLAS | GVPARFSGSGSGTSYSLTISSVEAEDDATYYC | RQWSGYPWT | FGGGTKLEIK | 213 |
| SC16.101 | QIVLTQSPAIMSASLGERVTMTC | TASSVSSSYLH | WYQQKPGSSPKLWIY | STSNLAS | GVPARFSGSESGTSYSLTISNMEAEDAATYYC | HQYHRSPFT | FGSGTKLPLT | 217 |
| SC16.103 | DIVLTQSPASLAVSLGQRATISC | RASKSVSTSGYSYMH | WYQQKPGQPPKLLIY | LASNLES | GVPARFSGSGSGTDFTLNIHPVEEEDAATYYC | QHSRELPLT | FGAGTKLELK | 221 |
| SC16.104 | QIVLSQSPAILSASPGEKVTMTC | RASSSVSYH | WYRQKPGSSPKPWIY | ATSNLAS | GVPARFSGSGSGTSYSLTISRVEAEDAATYYC | QQWSSNPPT | FGAGTKLELK | 225 |
| SC16.105 | DIVMTQSHKFMSTSVGDRVSITC | KASQDVGTAVA | WYQQKPGQSPKLLIY | WASIRHT | GVPDRFTGSGSGTDFTLTISNVQEDLADYFC | QQYSSYPLT | FGAGTKLELK | 229 |
| SC16.106 | DIKMTQSPSSMYASLGERVTITC | KASQDINSYLS | WFQQKPGKSPKTLIY | RANRLVD | GVPSRFSGSGSGQDYSLTISSLEVEDMGIYYC | LQYDEFPFT | FGSGTKLEIK | 233 |
| SC16.107 | DIVMTQSHKFMSTSVGDRVSITC | KASQDVNTAVG | WYQQKPGQSPKLLIY | SASYRYT | GVPDRFTGSGSGTDFTFTISVQAEDLAVYYC | QQHYSSPYT | FGGGTKVEIK | 237 |
| SC16.108 | DIQMTQSPASLSASVGETVTITC | RASENIYSLA | WYQQKQGKSPQLLVY | NAKTLAE | GVPSRFSGSRSGSQFSLKINSLQPEDFGSYYC | QHHYGTPYT | FGGGTKLEIK | 241 |
| SC16.109 | QIVLTQSPAIMSASPGEKVTMTC | SASSSVSYMY | WYQQKPGSSPRLLIY | DTSNLAS | GVPVRFSGSGSGTSFSLTISRMEAEDTATYYC | QEWSGNPLT | FGDGTKLEIK | 245 |
| SC16.110 | NIVMTQTPKFLLVSAGDRVTITC | KASQSVSNDVA | WYQQKPGQSPKLUY | YASNRYT | GVPDRFTGSGYGTDFTFTISTVQAEDLAVYFC | QQDYSSPPT | FGGGTKLEIK | 249 |
| SC16.111 | DIQMTQSPASLAASVGETVTITC | RASENIYSLA | WYQQKQGKSPQLLUY | NANSLED | GVPSRFSGSGSGTQYSMKINSMQPEDTATYFC | KQTYDVPLT | FGAGTKLELK | 253 |
| SC16.113 | DVVMTQTPLTLSVTIGQPASISC | KSSQSLLDSDGTTYLN | WLLQRPGQSPKRLIY | LVSKLDS | GVPDRFTGSGSGTDFTLKISRVEAEDLGVYYC | WQGTHFPLT | FGAGTKLELK | 257 |
| SC16.114 | QIVLSQSPAILSASPGEKVTMTC | RASSSVSYMH | WYQQKPGSSPKPWIY | ATSNLAS | GVPARFSGSGSGTSYSLTISRVEAEDAATYYC | QQWSSNPYT | FGGGTKLEIK | 261 |
| SC16.115 | DVVMTQTPLTLSVTIGQPASISC | KSSQSLLDSDGTTYLN | WLLQRPGQSPKRLIY | LVSKLDS | GVPDRFTGSGSGTDFTLKSRVEAEDLGVYYC | WQGTHFPLT | FGAGTKLELK | 265 |

FIG. 3A cont.

Amino Acid Sequences of Exemplary Murine anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.116 | DIVMTQSPFSSLTVTAGEKVTMSC | TSSQSLLTSGNQKNYLT | WYQQKPGQPKLLIY | WASTRES | GVPDRFTGSGSGTDFTLTISSLQAEDLAVYYC | QNDYSLT | FGAGTKLELK | 269 |
| SC16.117 | DIQMNQSPSSLSASLGDTITITC | HVSQNINVWLS | WYQQKPGNIPKLLIQ | KASNLHT | GVPSRFSGSGSGTGFTLTISSLQPEDIATYYC | QQGQSYPFT | FGSGTKLEIK | 273 |
| SC16.118 | DIVLTQSPASLAVSLGQRATISC | KASQSVDYDGDSYLT | WYQQKPGQPKLLIY | AASNLES | GIPARFSGSGSGTDFTLNIHPVEEEDAATYYC | QQSNEDPYT | FGGGTKLEIK | 277 |
| SC16.120 | DIVMSQSPSSLAVSVGERVTMSC | KSSQSLLYSSTQKNYLA | WYQQKPGQSPKLLIY | WASTRES | GVPDRFTGSGSGTDFTLTISSVKAEDLAVYYC | QQYSVPYT | FGGGTKLEIK | 281 |
| SC16.121 | QIVLTQSPAIMSASPGEKVTITC | SASSSVSYMH | WFQQKPGTSPKLWIY | STSNLAS | GVPARFSGSGSGTSYSLTISRMEAEDAATYYC | QQRSSVPPT | FGGGTKLEIK | 285 |
| SC16.122 | DIVMTQSQKFMSTSVGDRVSVTC | KASQNVGTNVA | WYQQKPGQSPKVLIY | SASYRYS | GVPDRFTGSGSGTDFTLTISNVQSEDLAEFFC | QQYNSVPLT | FGGGTKLEIK | 289 |
| SC16.123 | QIVLTQSPAIMSASLGERVTMTC | TASSSVSSYLH | WYQQKPGSSPKLWIY | STSNLAS | GVPARFSGSGSGTSYSLTISSMETEDAATYYC | HQYHRSPFT | FGSGTKLEIK | 293 |
| SC16.124 | DIQMTQSPASQSASLGESVTITC | LASQTIGTWLA | WYQQKPGKSPQLLIS | AATSLAD | GVPSRFSGSGSGTKFSFKISSLQAEDFVSYYC | QQLYSTPWT | FGGGTKLEIK | 297 |
| SC16.125 | DIQMNQSPSSLSASLGDTITITC | HASQNINVWLS | WYQQKPGNIPKLLIY | KASILHT | GVPSRFSGSGSGTGFTLTISSLQPEDIATYSC | QQGQSYPYT | FGSGTKLEIK | 301 |
| SC16.126 | DIQMNQSPSSLSASLGDTITITC | HASQNINVWLS | WYQQKPGNIPKLLIY | KASNLHT | GVPSRFSGSGSGTGFTLTISSLQPEDIATYYC | QQGQSYPFT | FGSGTKLEIK | 305 |
| SC16.129 | DIQMTQSPASQSASLGESVTITC | LASQTIGTWLA | WYQQKPGKSPQLLIY | AATSLAD | GVPSRFSGSGSGTKFSFKISSLQAEDFVSYYC | QQLYSTPYT | FGGGTKLEIK | 309 |
| SC16.130 | DIQLTQSPASLSASVGETVTITC | RASGSIHNYLA | WYQQKQGKSPQLLVY | NAKTLVD | GVPSRFSGSGSGTQYSLKINSLQPEDFGYYYC | QHFWTTPWT | FGGGTKLEIK | 313 |
| SC16.131 | DIQMNQSPSSLSASLGDTITITC | HVSQNINVWLS | WYQQKPGNIPKLLIQ | KASNLHT | GVPSRFSGSGSGTGFTLTISSLQPEDIATYYC | QQGQSYPFT | FGSGTKLEIK | 317 |
| SC16.132 | DIQMTQSPASQSASLGESVTITC | LASQTIGTWLA | WYQQKPGKSPQLLIY | AATSLAD | GVPSRFSGSGSGTKFSFKISSLQAEDFVSYYC | QQLYSTPWT | FGGGTKLEIK | 321 |
| SC16.133 | SIVMTQTPKFLLVSAGDRVTITC | KASQSVSNDVA | WYQQKPGQSPKLLIY | CASNRYT | GVPDRFTGSGVGTDFFFTSTVQAEDLAVYFC | QQDYSSPLT | FGAGTKLEIK | 325 |
| SC16.134 | DIVLTQSPASLAVSLGQRATISC | KASQSVDHAGDSYMN | WYQQKPGQPPKLLIY | AASNLES | GIPARFSGSGSGTDFTLNIHPVEEEDAATYYC | QQSNEDPYT | FGGGTKLEIK | 329 |
| SC16.135 | DIKMTQSPSSMYASLGERVTITC | KASQDINRYLS | WFQQKPGKSPKTLIY | RANRLVD | GVPSRFSGSSGSGQDYSLTISSLEYEDMGIYYC | LQYDEPPFT | FGSGTKLEIK | 333 |
| SC16.136 | DIQMTQSPASLSASVGETVTITC | RASGNIHNYLA | WYQQKQGKSPHLLVY | NAKTLAD | GVPSRFSGSGSGTQYSLKINSLQPEDFGSYYC | QHFWSTPWT | FGGGTKLEIK | 337 |
| SC16.137 | QIVLTQSPAIMSASLGEEITLTC | SASSSVSYMH | WYQQKSGTSPKLLIY | STSNLAS | GVPSRFSGSGSGTPYSLTISSVEAEDAADYYC | HQWSSYHT | FGGGTKLEIK | 341 |

FIG. 3A cont.

Amino Acid Sequences of Exemplary Murine anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| SC16.138 | DIQMTQSPASQSASLGESVTITC | LASQTIGTWLA | WYQQKPGKSPQLLIY | SATSLAD | GVPSRFSGSGSGTKFSFKISSLQAEDFVSYC | QQLYSTPWT | FGGGTKLEIK | 345 |
| SC16.139 | DIVMTQSHKFMSTSVGDRVSITC | KASQDVNTAVG | WYQQKPGQSPKLLIY | SASVRYT | GVPDRFTGSGSGTDFTFTISSVQAEDLAVYYC | QQHYSSPYT | FGGGTKLEIK | 349 |
| SC16.140 | DIVLTQSLASLAVSLGQRATISC | RASKSVSTSGYSYMH | WYQQKPGQPPKLLIY | LASNLES | GVPARFSGSGSGTDFTLNIHPVEDEDAATYYC | QHSRELPFT | FGGGTKLEIK | 353 |
| SC16.141 | DIKMTQSPSSMYASLGERVTITC | KASQDINSYLS | WFQQKPGKSPKTLIY | RANRLVD | GVPSRFSGSGSGQDYSLTISSLEYEDMGIYYC | LQYDEFPFT | FGSGTKLEIK | 357 |
| SC16.142 | DIKMTQSPSSMYASLGERVTITC | KASQDINNYLS | WFQQKPGKSPKTLIY | RANRLVD | GVPSRFSGSGSGQDYSLTISSLEYEDMGIYYC | LQYDEFPYT | FGGGTKLEIK | 361 |
| SC16.143 | DVLMTQTPLSLPVSLGDQASISC | RSSQSIVHSNGNTYLE | WYLQKPGQSPKLLIY | KVSNRFS | GVPDRFSGSGSGTDFTLKISRVEAEDLGVYYC | FQGSHVPLT | FGAGTKLEIK | 365 |
| SC16.144 | SIVMTQTPKFLLVSAGDRVTITC | KASQSVSNDVG | WYQQKPGQSPKLLIY | YASNRYN | GVPDRFTGSGVGTDFTFTISTVQAEDLAVYFC | QQDYSSPWT | FGGGTKLEIK | 369 |
| SC16.147 | DIQMTQTASSLSASLGDRVTISC | RASQDINNYLN | WYQQKPDGTVKLLIY | YTSRLHS | GVPSRFSGSGSGTDYSLTISILEQEDIATYFC | QQGDTLPWT | FGGGTKLEIK | 373 |
| SC16.148 | QIVLTQSPAIMSASPGEKVTMTC | SASSSVSYMY | WYQQKPGSSPRLLIY | DTSNLAS | GVPVRFSGSGSGTSYSLTISRMEAEDTATYYC | QEWSNNPLT | FGDGTKLEIK | 377 |
| SC16.149 | DIQMNQSPSSLSASLGQTITITC | HASQNINVWLS | WYQQKPGNIPKLLIY | KASHLHT | GVPSRLSGSGSGTGFTLTISSLQPEDIATYYC | QQGQSYPFT | FGSGTTLEIK | 381 |
| SC16.150 | DIVMSQSPSSLTVSVGEKVTMSC | MSSQSLLYSSTQKNYLA | WYQQKPGQSPKLLIY | WASTRES | GVPDRFTGSGSGTDFTLTISSVKAEDLAVYYC | QQYSYPYT | FGGGTKLEIK | 385 |

FIG. 3A cont.

Amino Acid Sequences of Exemplary Humanized
anti-DLL3 Antibody Light Chain Variable Regions

| mAb | FR1 | CDR1 | FR2 | CDR2 | FR3 | CDR3 | FR4 | SEQ ID NO. |
|---|---|---|---|---|---|---|---|---|
| hSC16.13 | DIQMTQSPSSLSASVGDRVTITC | SASSSVSYMY | WYQQKPGKAPKLLIY | LTSNLAS | GVPSRFSGSGSGTDFTLTISSLQPEDFATYYC | QQWRSNPFT | FGQGTKLEIK | 389 |
| hSC16.15 | AIQLTQSPSSLSASVGDRVTITC | RASENIYYNLA | WYQQKPGKAPKLLIY | TANSLED | GVPSRFSGSGSGTDFTLTISSLQPEDFATYFC | KQAYDVPPT | FGGGTKLEIK | 393 |
| hSC16.25 | EIVLTQSPDFQSVTPKEKVTITC | SASSSVSYMH | WYQQKPDQSPKLLIK | DSSKLAS | GVPSRFSGSGSGTDFTLTINSLEAEDAATYYC | QQWSSNPLT | FGQGTKLEIK | 397 |
| hSC16.34 | DIQMTQSPSSLSASVGDRVTITC | KASQSVSNDVA | WYQQKPGKVPKLLIY | YASNRYS | GVPSRFSGSGSGTDFTLTISSLQPEDVATYFC | QQDYSSPWT | FGGGTKVEIK | 401 |
| hSC16.56 | EIVMTQSPATLSVSPGERATLSC | KASQSVSNDVV | WYQQKPGQAPRLLIY | YASNRYT | GIPARFSGSGSGTEFTLTISSLQSEDFAVYYC | QQDYTSPWT | FGQGTKLEIK | 405 |

FIG. 3A cont.

Amino Acid Sequences of Exemplary Murine
anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.3 | QVTLKESGPGILQPSQTLSLTCSFSGFSLS | TSGMGVG | WIRQPSGKGLEWLA | HIWWDDVKRYNPALKS | RLTISKDTSSSQVFLKIASVDTADTATYFCAR | IADYGGDYYAMDY | WGQGTSVTVSS | 23 |
| SC16.4 | QIQLVQSGPELKKPGETVKISCKASGYTFT | DYSMH | WVKQAPGKGLKWMG | WINTETGEPGYADDFKG | RFAFSLETSASTAYLQINNLKNEDTATYFCAR | YDGYAMDY | WGQGTSVTVSS | 27 |
| SC16.5 | QVTLKESGPGILQPSQTLSLTCSFSGFSLS | TSGMGVG | WIRQPSGEGLEWLA | DIWWDDNKYYNPSLKS | RLTISKDTSSNQVFLKITSVDTADTATYFCAR | RVNVYDPYYAMDY | WGQGTSVTVSS | 31 |
| SC16.7 | EVQLQQSGPELVKPGASVKISCKASGYSFT | GYKMH | WVKQSHVKSLEWIG | RINPYNGATSYNQNFKD | KATLTVDKSSSTAYMDLHSLTSEDSAVYFCAR | GDYRYDWFAY | WGQGTLVTVSA | 35 |
| SC16.8 | QAQLQQSGAELVRPGTSVKVSCKASGYAFT | NYLIE | WVKQRPGQGLEWIG | VINPGTGGTNYNPVLKS | KATLTADKSSSTAYMQLSSLTSDDSAVYFCAR | SPYDYHEGAMDY | WGQGTSVTVSS | 39 |
| SC16.10 | QVTLKESGPGILQSSQTLSLTCSFSGFSLS | TSGMGVG | WIRQPSGKGLEWLA | HIWWDDVKRYNPVLKS | RLTISKDTSSSQVFLKIASVDTADTATYFCAR | LVDDLYYFDY | WGQGTLTLVSS | 43 |
| SC16.11 | QIQLVQSGPELKKPGETVKISCKASGYTFT | DYSMH | WVKQAPGKGLKWMG | WINTETVEPTYADDFMG | RFAFSLETSASTAFLQINNLNEDTATYFCAR | FGSYAMDY | WGQGTSVTVSS | 47 |
| SC16.13 | QVTLKESGPGILQPSQTLSLTCSFSGFSLS | TSGMGVG | WIRQPSGKGLEWLA | HIWWDDVKRYNPALKS | RLTISKDTSSSQVFLKIASVDTADTATYFCAR | IVSFDNDVSAMDY | WGQGTSVTVSS | 51 |
| SC16.15 | QVQLQQSGAELAKPGASVKMSCKASGYTFT | RYWIH | WIKQRPGQGLEWIG | YINPTTVTEFNQNFKD | KATLTADKSSTTASMQLSSLTSEDSAVYYCAR | GGSNFFDY | WGQGTTLTVSS | 55 |
| SC16.18 | EVKLEESGGGLVQPGESMKLSCAASGFTFS | DAWMD | WVRQSPEKGLEWVA | EIRNKANNHATYYAESVKG | KFTISRDDSKSRVYLQMINNLRAADTGIYYCTA | YSNFAY | WGQGTLVTVST | 59 |
| SC16.19 | EVQLQQSGAELVRPGASVKLSCTASGFNIK | DSLLH | WVKQRPEKGLEWIG | WIDPEDGETKYAPNFQD | KATITTDSSSNTAYLQLISLTSVDTAIYYCAY | GNVVRHFDY | WGQGTTLTVSS | 63 |
| SC16.20 | QVQLQQSGTELVRPGTSVRVSCKASGYAFG | NHLIE | WVKQRPGQGLEWIG | VINPGTGGTHYNEKFKD | KARLTADKSSNTAYMHLNSLTSDDSAVYFCAR | SPYDYHEGAMDY | WGQGTSVTVSS | 67 |
| SC16.21 | QVQLQQSGPELVKPGASVKISCKASGYAFS | SSWMN | WVKQRPGKGLEWIG | RIYPGDGDTNYNGKFKG | KATLTADKSSSTAYMQLSSLTSEDSAVYFCAM | GIYNYDGSRYYSMDY | WGQGTSVTVSS | 71 |
| SC16.22 | QVQLQQSGAELVKPGASVKLSCKASGYTFT | TVWMH | WVKQRPGQGLEWIG | EIDPSDSYTYYNQKFKG | KATLTVDKSSSTAYMQLSSLTSEDSAVVYCAR | GDYGNPYAMDY | WGQGSSVTVSS | 75 |
| SC16.23 | QVTLKESGPGILQPSQTLSLTCSFSGFSLS | TSNTGIG | WIRQPSGTGLEWLA | HIWWNDDKYYNPSLKS | RLTISKETSNNQVFLKITNVDTADTASYFCVQ | IGRDYSNYAWYFDV | WGAGTTVTVSS | 79 |
| SC16.25 | QVTLKESGPGILQPSQTLSLTCSFSGFSLS | TSGMGVG | WIRQPSGEGLEWLT | DIWWDDNKYYNPSLKS | RLTISKDTSSNQVFLNITSVDTADTATYFCAR | RVNVYDPYYAMDY | WGQGTSVTVSS | 83 |
| SC16.26 | QIQLVQSGPELKKPGETVKISCKASGYSFT | DYSMH | WVKQAPGKGLKWMG | WINTETVEPTYADDFMG | RFAFSLETSASTAFLQINNLNEDTATYFCAR | FGSYAMDY | WGQGTSVTVSS | 87 |
| SC16.29 | QVQLVQSGAELARPGASVKLSCKASGYTFT | DQYIN | WVKQRTGQGLEWIG | EIYPGRGNTYYNEKFKG | KATLTADKSSSTAYMQLSSLTSEDSAVYFCAR | EDGGYDDAWFAY | WGQGTLVTVSA | 91 |
| SC16.30 | QVTLKESGPGILQPSQTLSLTCSFSGFSLS | TSGMGVG | WIRQPSGKGLEWLA | HIWWDDVKRYKPALKS | RLTVSKDTSSNQVFLKIATVDAADTGTYCAR | IVDGHPPFAY | WGQGTLVTVSA | 95 |
| SC16.31 | EVQLQQSGPELVKPGASVKISCKASGYSFS | RPYMH | WVKQSPENSLEWIG | EINPSTGGTSYNQKFKG | KATLTVDKSSSTAYMQLKSLTSEESAVYYCTR | GVGSNMWYFDV | WGAGTTVTVST | 99 |

FIG. 3B

Amino Acid Sequences of Exemplary Murine anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.34 | QIQLVQSGPELKRPGETVKISCKASGYTFT | NYGMN | WVKQAPGKGLKWMG | WINTYTGDPTYADDFKG | RFAFSLETSASTAYLQINNLKNEDTATYFCAR | IGGNSPSDY | WGQGTSLTVSS | 103 |
| SC16.35 | DVQLQESGPGLVKPSQSLSLTCTVTGYSIT | SDYAWN | WIRQFPGNKLEWMG | YISYSGSTSYNPSLKS | RISITRDTSKNQFFLQLNSVTTEDTATYYCAR | FYGSSYAMDY | WGQGTSVTVSS | 107 |
| SC16.36 | QVQLQQSGAELAKPGASVKMSCKASGYTFT | TYWMH | WVKQRPGQGLEWIG | YINPSSGYTEYNQKFKD | KATLTADKSSSTAYMQLSSLTSEDSSVYYCAR | KGSNRGFAY | WGQGTLVTVSS | 111 |
| SC16.38 | EVQLQQSGAELVKPGASVKLSCTVSGFNIK | DTYIH | WVKQRPEQGLEWIG | RIDPANGNTKYDPKFQG | KATTADTSNTAYLQLSSLTSEDTAVYYCAR | PTGYFEY | WGQGTTLTVSS | 115 |
| SC16.41 | EVKLEESGGGLVQPGGSMKLSCAASGFTFS | DAWMD | WVRQSPEKGLEWVA | EIRNKANNHATYYPESVKG | RFTISRDDSKSRVYLQMNNLRAEDTGIYYCTG | YSSFAY | WGQGTLVTVSA | 119 |
| SC16.42 | QIQLVQSGPELKKPGETVKISCKASGYTF | TAGMQ | WVQKMPGKGFKWIG | WINTHSGEPKYADDFKG | RFAFSLETSASTAYLQISNLKDEDTATFFCAP | LWSDSSFAY | WGQGTLVTVSA | 123 |
| SC16.45 | QVQLQQSGADLVRPGTSVKVSCKASGYSFT | NYLIE | WVKQRPGQGLEWIG | VINPGSGGTHYNEKFKD | KAVLTADKSSTTAHMQLSSLTSDDSAVYFCAR | SPYDYNDGAMDY | WGQGTSVTVSS | 127 |
| SC16.47 | EVQLQQSGPELVKPGASVKISCKASGYSFS | RPYMH | WVKQSPENSLEWIG | EINPSTGGTSYNQKFKG | KATLTVDKSSSTAYMQLKSLTSEESAVYYCTR | GYGSNCYFDV | WGAGTTVTVST | 131 |
| SC16.49 | QVQLQQSGPELVKPGTLVKISCKASGYTFT | SYDIN | WVKQRPGQGLEWIG | WIYPGDGNTKYSEKFKG | KATLTADKSSSTAYMQLTSLTSENSAVYFCAR | DYDYPFAY | WGQGTLVTVSA | 135 |
| SC16.50 | EVQLVECGCGLVKPGGYLKLSCAASGFTFS | SYAMS | WVRQSPEKRLEWVA | EISIGGSYTYYPDTVTG | RFTISRDNAKNTLYLEMSSLRSEDTAMYYCAR | EGYDYDVRAMDY | WGQGTSVTVSS | 139 |
| SC16.52 | QVQLKESGPGLVAPSQSLSITCAVSGFSLT | SFAIH | WFRKPPGKGLEWLG | VIWTGGTTNVNSALMS | RLSISKDNSKSQVFLKMNSLQTDDTAMYYCAR | DDYDNNYAMDY | WGQGTTLTVSS | 143 |
| SC16.55 | EVQLVESGGGLVQPKGSLKLSCAVSAFFT | TYAMN | WVRQAPGKGLEWVA | RIRNKSNNYATYYADSVKD | RFTISRDDSQSMLYLQMNNLKIEDTAMYYCVF | YYDYVY | WGQGTLVTVSA | 147 |
| SC16.56 | QIQLVQSGPELKKPGETVKISCKASGYTFT | NYGMN | WVKQAPGKGLKWMA | WINTYTGEPTYADDFKG | RFAFSLETSASTASLQIINLKNEDTATYFCAR | IGDSSPSDY | WGQGTTLTVSS | 151 |
| SC16.57 | EVKLVESGGDLVKPGGSLKLSCAASGFAFS | SYDMS | WVRQTPEKRLEWVA | TISSGGSYTYPDSVKG | RFTISRDNVRDTLYLQMSSLRSEDTALYYCAR | QAIGTYFDY | WGQGTTLTVSS | 155 |
| SC16.58 | DVQLVESGSGGLVQPGGSRKLSCAASGFTFS | SFGMH | WVRQAPEKGLEWVA | YISSGSSNIYYADTVKG | RFTISRDNPKNTLFLQMTSLRSEDTAMYYCAR | GYYGNVDAMDY | WGQGTSVTVSS | 159 |
| SC16.61 | EVLLQRSGPDLVKPGASVTIPCKASGYTFT | DYNMD | WVKQSHGKSLEWIG | NINTYNGGTIYNQKFKG | KATLTVDKPSSTAYMELRSLTSEDTAVYYCAR | RLRYGGHYFDY | WGQGTALTVSS | 163 |
| SC16.62 | EVMLVESGGDLVKPGGSLKLSCAASGFTFS | SYAMS | WVRQTPEKRLEWVA | YISGGGDIHYYPDSVRG | RFTISRDNAKDTLYLQMSSLRSEDTALYDCAR | VRDWYFDV | WGAGTTVTVSS | 167 |
| SC16.63 | QVQLQQSGSTELLRPGASVKISCKATGYTFS | SWWME | WVKQRPGHGLEWIG | EILPGSGTTQYNEKFKG | KATFTADTSNTAYMHLSSLTSEDSAVYYCAR | GTNSL | WGQGTLVTVSA | 171 |
| SC16.65 | QVTLKESGPGILQPSQTLSLTCSFSGFSLS | TSGMGVG | WIRQPSGKGLEWLA | LIWWDVKRYNPALKS | RLTISKDASSSQVFLKIASVDTADTATYYCAR | IASYDVVYAMDY | WGQGTSVSVSS | 175 |
| SC16.67 | EVQLVETGGGLVQPKGSLKLSCAVSAFFT | TYAMN | WVRQAPGKGLEWVA | RIRNKSNNYATYYADSVKD | RFTISRDDSQSMLYLQMNNLKIEDTAMYYCVF | YYDYVY | WGQGTLVTVSA | 179 |

FIG. 3B cont.

Amino Acid Sequences of Exemplary Murine
anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.68 | QVQLQQPGAELVKPGASVKMSCKASGYTFT | NYNMH | WVKQTPGQGLEWIG | AIFPGNGGTSYNQKFKG | KATLTADKSSSTAYMQLTSLTSGDSAVYYCAR | WGYGSGLYAMDY | WGQGTSVTVSS | 183 |
| SC16.72 | EVQLQQSGPELVKPGASVKMSCKASGYTFT | SYVMH | WVKQPGQGLEWIG | YINPYNDGTKYNEKFKG | KATLTDKSSSTAYMELSLTSEDSAVYYCAR | LRSRAMDY | WGQGTSVTVSS | 187 |
| SC16.73 | QVQLQQSGAELMKPGASVKISCKANGYTFS | SYWIE | WLRQRPGHGLEWIG | EILPGSDNSNVNEKFKG | KATFTADTSNTAYMQLSLTSEESAVYYCTR | GLRRDGSYYVMEH | WGQGTSVTVSS | 191 |
| SC16.78 | EVKLVESGGGLVKPGGSLKLSCAASGFTFG | RYVMS | WVRQTPEKLEWVA | SITSGGTTYYPDSVKG | RFTISRDNARNILYLQMSSLRSEDTAMYYCAR | VYVHYDDIFAY | WGQGTLVTVSA | 195 |
| SC16.79 | EVQLQQSGPELVKPGASVKISCKTSGYTF | EYTMH | WVKQSHGKSLEWIG | GINPNNGGTSYNQKFKG | KATLTVDKSSSTAYMELRSLTSEDSAVYYCAR | GPAWFAY | WGQGTLVTVSA | 199 |
| SC16.80 | EVQLQQSGPELVKPGGSKKISCKASGYSFT | GYSMN | WVKQSHGKNLEWIG | LINPYSGGTNYNQKFKG | KATLTVDKSSSTAYMELLSLTSEDSAVYYCAR | RSDYPLVY | WGQGTLVTVSA | 203 |
| SC16.81 | QVQLKESGPVLVAPSQSLSITCTVSGFSLT | SYGVH | WVRQPPGSKGLEWLG | VIWAGGSTNYNSALMS | RLSISKDNSKSQVFLKMNSLQTDDTAMYYCAK | QGNFYAMDY | WGQGTSVTVSS | 207 |
| SC16.84 | EVQLQQSGPELVKPGASMKISCKASGYSFT | GYTMN | WVKQSHGKNLEWIG | LINPYNGGTTYNQKFKG | KATLTVDKSSSTAYMELLSLTSEDSAVYYCAL | GYYGNYRRYFDV | WGAGTTVTVSS | 211 |
| SC16.88 | QVQLQQSGAELARPGASVKLSCKASGYTCT | SVWMQ | WVKQRPGQGLEWIG | AIYPGDGDTRYTQKFKG | KATLTADKSSSTAYMQLSLSASEDSAVYYCAR | GRRTEAWFAY | WGQGTLVTVSA | 215 |
| SC16.101 | QVTLKESGPGILQPSQTLSLTCSFSGFSLS | TSGMGVG | WIRQPSGKGLEWLA | HIWWDVKRYNPALKS | RLTISKDASSSQVFLKIASVDTAETATYYCAH | ILDRAYYFDY | WGQGTTLTVTS | 219 |
| SC16.103 | QVTLKESGPGILKPSQTLSLTCSFSGFSLS | TSGMGIG | WIRQPSGKGLEWLA | HIWWDDDKYYNPSLKS | QLTISKDSSRNQVFLKITSVDTADTATYYCAR | RGTAYYFDY | WGQGTTLTVSS | 223 |
| SC16.104 | QVQLKESGPDLVQPSQTLSLTCTVSGFSLT | FYGVH | WVRQPPGSKGLEWVG | TMGWDDKKYYNSALKS | RLSISRDTSKNQVFLKLSLLQTEDTAMYYCTR | GGTGFDY | WGQGTTLTVSS | 227 |
| SC16.105 | QVQLQQPGAELVKPGASVKLSCKASGYTFT | SVWMH | WVKQRPGQGLEWIG | VINPSNGRTNYNEKFKS | KATLTVDKSSSTAYMQLSLTSEDSAVYYCAR | RRELGTLYAMDY | WGQGTSVTVSS | 231 |
| SC16.106 | QVQLKQSGPGLVAPSQSLFITCTVSGFSLT | SYEIN | WVRQPSGKGLEWLG | VIWTGGSTNYNSALIS | RLSISKDNSKSLVFLKMNSLQTDDTAIYYCVR | GVYAMDY | WGQGTSVTVSS | 235 |
| SC16.107 | EVQLQQSGPELVKPGASVKMSCKASGYTFT | NVVMH | WVKQKPGQGLEWIG | YINPYNDGTKYNEKFKG | KATLTDKSSSTTAYMALSLTSEDSAVYYCAV | AYSNWGFAY | WGQGTLVTVSA | 239 |
| SC16.108 | QVQLEESGAELARPGASVKLSCKASGYSVW | MQ | WIKQRPGQGLEWIG | AIYPGNGDTRYTQKFKG | KATLTADKSSSTAYMQLSLSASEDSAVYYCAR | SPAYYRYGEGYFDY | WGQGTLVTVSS | 243 |
| SC16.109 | QIQLVQSGPELKKPGETVKISCKASGYTFT | NYGMN | WVKQAPGKGLKWMG | WINTYTGEPAYADDFKG | RFAFSLETSASAAYLQINNLKNEDTATFFCAN | MRPTRGFAY | WGQGTLGTVSA | 247 |
| SC16.110 | EVQLQQSGPGLVRTGASVKISCKASGYSFT | GYYMH | WVKQSHGKSLEWIG | YISCVNGATTYNQNFKG | KATFIVDTSSSTAYMQFNSLTSEDSAVYYCAR | SDGGHAMDY | WGQGTSVTVSS | 251 |
| SC16.111 | EVQLQQSGPELEKPGASVKISCKASGYSFT | GYNMN | WVKQSNGKSLEWIG | NIDPYVGGSSYKQKFEG | KATLTVDKSSSTAYMQLKLSLTSEDSAVYYCAR | GGSNFFDY | WGQGTTLTVSS | 255 |

FIG. 3B cont.

Amino Acid Sequences of Exemplary Murine anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.113 | DVKLVESGGGLVKPGGSLKLSCAASGFTFS | SYTMS | WVRQTPEKRLEWVA | TISSGGSYPYYPDSVKG | RFTISRDNAKNTLYLQMSSLKSEDTAMYYCTR | DVDGYSY | WGQGTTLTVSS | 259 |
| SC16.114 | EVQLQQSGAELVKPGASVKLSCTASGFNIK | DTYIH | WVKQRPEQGLEWIG | RIDPANGNTKVDPKFQG | KATITPDTSSNTAYLQLSSLTSEDTAVYYCAR | SWRNYGSSFWYFDV | WGAGTTVTVSS | 263 |
| SC16.115 | DVKLVESGGGLVKPGGSLKLSCAASGFTFS | SYTMS | WVRQTPEKRLEWVA | TISSGGSYPYYPDSVKG | RFTISRDNAKNTLYLQMSSLKSEDTAMYYCTR | DVDGYSY | WGQGTTLTVSS | 267 |
| SC16.116 | QVQLKQSGPGRVQPSQSLSITCTVSGFSLT | SNGVH | WVRQSPGKGLEWLG | VLWSGGSTDYNAAFIS | RLSISKDNYKSQVFFKMNSLQANDTAIYYCAR | NNNRYGAMDY | WGQGTSVTVSS | 271 |
| SC16.117 | QVQLKESGPGLVAPSQSLSITCTVSGFSLT | NYGVH | WVRQPPGKGLEWLG | VIWAGGITNYNSALMS | RLSISEDNSKSQVFLKMNSLQTDDTAMYYCAR | NLGPYAMDY | WGQGTSVTVSS | 275 |
| SC16.118 | EVQLQQSGPDLVKPGASVKISCKASGYSFT | GYYMH | WVKQSHGKSLEWIG | RVNPNNGGTSYNQKFKG | KAILTADKSSSTAYMELRSLTSEDSAVYYCAR | GSYDYAEG | WGQGTLVTVSA | 279 |
| SC16.120 | EIQLQQSGPELVKPGASVKVSCKASGYAFT | SYNMY | WVMQSHGKSLEWIG | YVDPYNGGTSYNQKFKG | KATLTVDKSSSTAYMHLNSLTSEDSAVYYCAR | ENYRFDY | WGQGTTLTVSS | 283 |
| SC16.121 | EVQLVESGGGLVQPKGSLKLSCAASGFTFN | TYAMN | WVRQAPGKGLEWVA | RIRIKSNNYATYYADSVKD | RFTISRDDSQNMILYLQMNINLKTEDTAVYYCVR | QQYSYDWGPWFAY | WGQGTLVTVSA | 287 |
| SC16.122 | EVQLVESGGGLVKPGGSLKLSCAASGFTFS | DYYMF | WVRQTPEKRLEWVA | TISDGGSYTYFPDSVKG | RFTISRDNAQNNLYLQMSSLKSEDTAMYYCAR | AGTLYAMDY | WGQGTSVTVSS | 291 |
| SC16.123 | QVALKESGPGILQPSQTLSLTCSFSGFSLS | TSGMGVG | WIRQPSGKGLEWLA | HIWWDDVKRYNPALKS | RLTISKDTSSSQVFLKIASVDTADTATYYCAR | MEDYGSSSYFDF | WGHGTTLTVSS | 295 |
| SC16.124 | EVQLQQSGPELVKPGASVKMSCKASGYTFT | SYVMH | WVKQKPGQGLEWIG | YINPYNDGTKYNEKFKG | KATLTSDKSSSTAYMELSSLTSEDSAVYYCAR | GALYYGNYLGYFDV | WGAGTTVTVSS | 299 |
| SC16.125 | DVQLQESGPDLVKPSQSLSLTCTVTGYSIT | SGYSWH | WIRQPFGNKLEWMG | YIHYSGSTNYNPSLKS | RISITRDTSKNQFFLQFKSVTTEDSATYYCAL | EGNYDGFAY | WGQGTLVTVSS | 303 |
| SC16.126 | QVQMKESGPGLVAPSQSLSITCTVSGSSLT | NYGVH | WVRQPPGKGLEWLG | VIWAGGSITNYNSALMS | RLSISEDNSIKSQVFLKMNSLQTDDTAMYYCAR | DWEGWFAY | WGQGTLVTVSA | 307 |
| SC16.129 | QVQLKESGPGLVAPSQSLSITCTVSGFSLT | DYGVS | WIRQPPGKGLEWIG | VIWGGGSTYYNSALKS | RLSISKDNSKSQVFLEIMSLQTDDTAIYYCAK | HYGHYAAY | WGQGTLVTVSA | 311 |
| SC16.130 | EVQLQQSGPELVKPGASVKMSCKASGYTFT | SYVMH | WVKQKPGQGLEWIG | YINPYNDGTEYNEKFKG | KATLTSDKSSSTAYMELSSLTSEDSAVYYCAR | GVDGYSYFDY | WGQGTTLTVSS | 315 |
| SC16.131 | QVQLKESGPGLVAPSQSLSITCTVSGFSLT | NYGVH | WVRQPPGKGLEWLG | VIWAGGITNYNSALMS | RLSISEDNSKSQVFLKMNSLQTDDTAMYYCAR | NLGPYAMDY | WGQGTSVTVSS | 319 |
| SC16.132 | QVQLKESGPGLVAPSQSLSITCTVSGFSLT | DYGVS | WIRQPPGKGLEWIG | VVWGGSTYYNSALKS | RLSITKDNSKSQVFLKMNSLQTDDTAMYYCAK | QRGQYGAY | WGQGTLVTVSA | 323 |
| SC16.133 | QVQLKESGPGLVAPSQSLSITCTVSGFSLT | NYAVH | WVRQSPGKGLEWIG | VIWSDGSTDYNAAFIS | RLSISKDNSKSQVFFKMNSLQADDTAMYYCAR | KKGGWFPWFAY | WGQGTLVTVSA | 327 |
| SC16.134 | EVQLQQSGPDLVKPGASVKISCKASGYSFT | GYYMH | WVKQSHGKRLEWIG | RVNPNNGGTNYNQKFKG | KAILTVDKSSSTAYMELRSLTSEDSAVYYCAR | GSYDNAEG | WGQGTLVTVSA | 331 |
| SC16.135 | QVQLQQSGAELVRPGTSVKVSCKASGYAFT | NYLIE | WVKQRPGQGLEWIG | VINPGSGGTNSNEKFKA | KATLTADKSSSTAYMQLLSSLTSADSAVYFCAR | SDYDYAPYAMDY | WGQGTSVTVSS | 335 |
| SC16.136 | EVQLQQSGPELVKPGASVKMSCKASGYTFT | SYVMH | WVKQKPGQGLEWIG | YINPYNDGTKYNEKFKG | KATLTSDKSSSTAYMELSSLTSEDSAVYYCAR | DRSGYEDYYGMDY | WGQGTSVTVSS | 339 |

FIG. 3B cont.

Amino Acid Sequences of Exemplary Murine anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| SC16.137 | EVQLVESGGDLVKPGGSLKLSCAASGFTFS | SYGMS | WVRQTPDKRLEWVA | TISSGSYTYYPDSVKG | RFTISRDNAKNTLYLQMSSLKSEDTAMYYCAR | RRADAMDY | WGQGTSVTVSS | 343 |
| SC16.138 | QVQLKESGPGLVAPSQSLSITCTVSGFSLT | DYGVS | WIRQPGKGLEWLG | VWWGGGSTYYNSALKS | RLSISKDNSKSQVFLKMNSLQTDDTAMYYCAK | QRGGYGAY | WGQGTLVTVSA | 347 |
| SC16.139 | EVQLQQSGPELVKPGASVKMSCKASGYTFT | NYVMH | WVKQKPGQGLEWIG | YINPYNDGTKYNEKFKG | KATLTSDKSSTTAYMALSSLTSEDSAVYYCAV | AYYSNWGFAY | WGQGTLVTVSA | 351 |
| SC16.140 | QVQLQQSGPELVRPGASVKMSCKASGYTFT | SYWMH | WVKQRPGQGLEWIG | MIDPSNSETRLNQKFKD | KATLNVDKSSNTAYMQLSSLTSEDSAVYYCAV | MDYFDY | WGQGTTLTVSS | 355 |
| SC16.141 | QVQLKQSGPGLVAPSQSLFTCTVSGFSLT | SYEIN | WVRQPPGKGLEWLG | VIWTGGSTNYNSALIS | RLSISKDNSKSLVFLKMNSLQTDDTAIYYCVR | GVYAMDY | WGQGTSVTVSS | 359 |
| SC16.142 | EVQLQQSGPELVKPGASVKISCKASGYTFT | DYNMH | WVKQSHGKSLEWIG | FFYPYNGNTVYSQKFKS | KATLTVDNSSSTAYMELRSLTSEDSAVYYCAR | LNWEGY | WGQGTTLTVSS | 363 |
| SC16.143 | QVQLQQSGPELVKPGASVR1SCKASGYTFT | SYYIH | WVKQRPGQGLEWIG | WIYPGNGNTKYNEKFKG | KATLTADKGSSTAYMQISSLTSEDSAVYFCAR | ERWLLLWFAY | WGQGTLVTVSA | 367 |
| SC16.144 | QIQLVQSGPELKKPGETVKISCKASGYTFT | NYGMN | WVKQAPGKGLKWVG | WINTYTGEPTYADDFKG | RFAFSLETSASTAYLQIDNLKNEDTATYFCAR | VGDVGFDY | WGQGTLTVSS | 371 |
| SC16.147 | QIQLVQSGPELTKPGETVKISCKASGYTFT | DYSLH | WVKQALGKGLKWMG | WINTETGEPAYADDFKG | RFAFSLETSASTAYLQINDLKNEDTTTYFCGI | YDGYAMDY | WGQGTSVTVSS | 375 |
| SC16.148 | QIQLVQSGPELKKPGETVKISCKASGYTLT | NYGMN | WVKQAPGKGLKWMG | WINTYTGEPTYADDFKG | RFAFSLETSARIVYLQINNLKNEDTATYFCAK | YEAHEGFVY | WGQGTLVTVSA | 379 |
| SC16.149 | QVQLKESGPGLVAPSQSLSITCAVSGFSLT | SFGVH | WVRQPPGKGLEWLG | VIWAGGSTNYYSALMS | RLSISIDNSKSQVFLKMNSLQTDDTAMYYCAR | DWEGWFAY | WGQGTLVTVSA | 383 |
| SC16.150 | EIQLQQSGPELVKPGASVKVSCKASGYAFT | SYNMY | WVSQSHGKSLEWIG | YIDPYNGGTSYNQKFRG | KATLTVDKSSSTAYMHLNSLTSEDSAVYYCAR | ENYRYDF | WGQGTTLVSS | 387 |

FIG. 3B cont.

Amino Acid Sequences of Exemplary Humanized
anti-DLL3 Antibody Heavy Chain Variable Regions

| mAb | FR1 | CDR1 | FR2 | CDR2 | FR3 | CDR3 | FR4 | SEQ ID NO. |
|---|---|---|---|---|---|---|---|---|
| hSC16.13 | QITLKESGPTLVKPTQTLTLTCTFSGFSLS | TSGMGVG | WIRQPPGKALEWLA | HIWWDDVKRYSPSLKS | RLTITKDTSKNQVVLTMTNMDPVDTATYYCAR | IVSFDNDVVSAMDY | WGQGTLVTVSS | 391 |
| hSC16.15 | QVQLVQSGAEVKKPGASVKVSCKASGYTFT | RYWIH | WIRQAPGQGGLEWMG | YINPTTVYTEFNQNFKD | RVTMTRDTSTSTVYMELSSLRSEDTAVYYCAR | GGSNFFDY | WGQGTTVTVSS | 395 |
| hSC16.25 | QITLKESGPTLVKPTQTLTLTCTFSGFSLS | TSGMGVG | WIRQPPGKALEWLT | DIWWDDNKYNPSLKS | RLTITKDTSKNQVVLTMTNMDPVDTATYYCAR | RVNYYYDPYYAMDY | WGQGTLVTVSS | 399 |
| hSC16.34 | QVQLVQSGAEVKKPGASVKVSCKASGYTFT | NYGMN | WVRQAPGQRLEWMG | WINTYTGDPTYADDFKG | RVTITRDTSASTAYMELSSLRSEDTAVYYCAR | IGGNSPSDY | WGQGTTVTVSS | 403 |
| hSC16.56 | QVQLVQSGAEVKKPGASVKVSCKASGYTFT | NYGMN | WVRQAPGQGLEWMG | WINTYTGEPTYADDFKG | RVTMTTDTSTSTAYMELRSLRSDDTAVYYCAR | IGDSSPSDY | WGQGTLVTVSS | 407 |

FIG. 3B cont.

Biochemical Characteristics of Selected DLL3 Modulators

| Clone | Bin | Domain | Affinity (nM) | Cyno XR | Mouse & Rat XR |
|---|---|---|---|---|---|
| SC16.4 | F | EGF4 | 0.5$^F$ | N.D. | Yes |
| SC16.8 | A | EGF5 | 0.5$^F$ | N.D. | Yes |
| SC16.10 | E | EGF2 | 4.0$^F$ | N.D. | No |
| SC16.13 | B | EGF2 | 2.0$^B$ | No$^Y$ | No |
| SC16.15 | G | N-terminal | 0.5$^B$ | Yes$^B$ | Yes |
| SC16.25 | C | N-terminal | 0.2$^B$ | Yes$^B$ | No |
| SC16.34 | D | DSL | 0.2$^B$ | Yes$^B$ | Yes |
| SC16.39 | I | EGF6 | 1.0$^F$ | N.D. | Yes |
| SC16.46 | A | EGF1 | 0.5$^F$ | No$^Y$ | Yes |
| SC16.51 | H | N-terminal | 2.0$^F$ | Yes$^B$ | Yes |
| SC16.56 | D | DSL | 1.0$^B$ | Yes$^B$ | Yes |
| SC16.65 | B | EGF2 | 0.9$^B$ | No$^B$ | No |
| SC16.67 | D | EGF3 | 0.5$^F$ | Yes$^Y$ | No |

$^B$ Biacore; $^F$ ForteBio; $^Y$ Yeast Display

FIG. 5

Exemplary Antibody Drug Conjugates

| ADC # | | ADC # | | ADC # | |
|---|---|---|---|---|---|
| 1 | SC16.3-DL1 | 32 | SC16.55-DL1 | 63 | SC16.116-DL1 |
| 2 | SC16.4-DL1 | 33 | SC16.56-DL1 | 64 | SC16.117-DL1 |
| 3 | SC16.5-DL1 | 34 | SC16.57-DL1 | 65 | SC16.118-DL1 |
| 4 | SC16.7-DL1 | 35 | SC16.58-DL1 | 66 | SC16.120-DL1 |
| 5 | SC16.8-DL1 | 36 | SC16.61-DL1 | 67 | SC16.121-DL1 |
| 6 | SC16.10-DL1 | 37 | SC16.62-DL1 | 68 | SC16.122-DL1 |
| 7 | SC16.11-DL1 | 38 | SC16.63-DL1 | 69 | SC16.123-DL1 |
| 8 | SC16.13-DL1 | 39 | SC16.65-DL1 | 70 | SC16.124-DL1 |
| 9 | SC16.15-DL1 | 40 | SC16.67-DL1 | 71 | SC16.125-DL1 |
| 10 | SC16.18-DL1 | 41 | SC16.68-DL1 | 72 | SC16.126-DL1 |
| 11 | SC16.19-DL1 | 42 | SC16.72-DL1 | 73 | SC16.129-DL1 |
| 12 | SC16.20-DL1 | 43 | SC16.73-DL1 | 74 | SC16.130-DL1 |
| 13 | SC16.21-DL1 | 44 | SC16.78-DL1 | 75 | SC16.131-DL1 |
| 14 | SC16.22-DL1 | 45 | SC16.79-DL1 | 76 | SC16.132-DL1 |
| 15 | SC16.23-DL1 | 46 | SC16.80-DL1 | 77 | SC16.133-DL1 |
| 16 | SC16.25-DL1 | 47 | SC16.81-DL1 | 78 | SC16.134-DL1 |
| 17 | SC16.26-DL1 | 48 | SC16.84-DL1 | 79 | SC16.135-DL1 |
| 18 | SC16.29-DL1 | 49 | SC16.88-DL1 | 80 | SC16.136-DL1 |
| 19 | SC16.30-DL1 | 50 | SC16.101-DL1 | 81 | SC16.137-DL1 |
| 20 | SC16.31-DL1 | 51 | SC16.103-DL1 | 82 | SC16.138-DL1 |
| 21 | SC16.34-DL1 | 52 | SC16.104-DL1 | 83 | SC16.139-DL1 |
| 22 | SC16.35-DL1 | 53 | SC16.105-DL1 | 84 | SC16.140-DL1 |
| 23 | SC16.36-DL1 | 54 | SC16.106-DL1 | 85 | SC16.141-DL1 |
| 24 | SC16.38-DL1 | 55 | SC16.107-DL1 | 86 | SC16.142-DL1 |
| 25 | SC16.41-DL1 | 56 | SC16.108-DL1 | 87 | SC16.143-DL1 |
| 26 | SC16.42-DL1 | 57 | SC16.109-DL1 | 88 | SC16.144-DL1 |
| 27 | SC16.45-DL1 | 58 | SC16.110-DL1 | 89 | SC16.147-DL1 |
| 28 | SC16.47-DL1 | 59 | SC16.111-DL1 | 90 | SC16.148-DL1 |
| 29 | SC16.49-DL1 | 60 | SC16.113-DL1 | 91 | SC16.149-DL1 |
| 30 | SC16.50-DL1 | 61 | SC16.114-DL1 | 92 | SC16.150-DL1 |
| 31 | SC16.52-DL1 | 62 | SC16.115-DL1 | | |

FIG. 6

Exemplary Antibody Drug Conjugates

| ADC # | | ADC # | | ADC # | |
|---|---|---|---|---|---|
| 93 | SC16.3-DL2 | 124 | SC16.55-DL2 | 155 | SC16.116-DL2 |
| 94 | SC16.4-DL2 | 125 | SC16.56-DL2 | 156 | SC16.117-DL2 |
| 95 | SC16.5-DL2 | 126 | SC16.57-DL2 | 157 | SC16.118-DL2 |
| 96 | SC16.7-DL2 | 127 | SC16.58-DL2 | 158 | SC16.120-DL2 |
| 97 | SC16.8-DL2 | 128 | SC16.61-DL2 | 159 | SC16.121-DL2 |
| 98 | SC16.10-DL2 | 129 | SC16.62-DL2 | 160 | SC16.122-DL2 |
| 99 | SC16.11-DL2 | 130 | SC16.63-DL2 | 161 | SC16.123-DL2 |
| 100 | SC16.13-DL2 | 131 | SC16.65-DL2 | 162 | SC16.124-DL2 |
| 101 | SC16.15-DL2 | 132 | SC16.67-DL2 | 163 | SC16.125-DL2 |
| 102 | SC16.18-DL2 | 133 | SC16.68-DL2 | 164 | SC16.126-DL2 |
| 103 | SC16.19-DL2 | 134 | SC16.72-DL2 | 165 | SC16.129-DL2 |
| 104 | SC16.20-DL2 | 135 | SC16.73-DL2 | 166 | SC16.130-DL2 |
| 105 | SC16.21-DL2 | 136 | SC16.78-DL2 | 167 | SC16.131-DL2 |
| 106 | SC16.22-DL2 | 137 | SC16.79-DL2 | 168 | SC16.132-DL2 |
| 107 | SC16.23-DL2 | 138 | SC16.80-DL2 | 169 | SC16.133-DL2 |
| 108 | SC16.25-DL2 | 139 | SC16.81-DL2 | 170 | SC16.134-DL2 |
| 109 | SC16.26-DL2 | 140 | SC16.84-DL2 | 171 | SC16.135-DL2 |
| 110 | SC16.29-DL2 | 141 | SC16.88-DL2 | 172 | SC16.136-DL2 |
| 111 | SC16.30-DL2 | 142 | SC16.101-DL2 | 173 | SC16.137-DL2 |
| 112 | SC16.31-DL2 | 143 | SC16.103-DL2 | 174 | SC16.138-DL2 |
| 113 | SC16.34-DL2 | 144 | SC16.104-DL2 | 175 | SC16.139-DL2 |
| 114 | SC16.35-DL2 | 145 | SC16.105-DL2 | 176 | SC16.140-DL2 |
| 115 | SC16.36-DL2 | 146 | SC16.106-DL2 | 177 | SC16.141-DL2 |
| 116 | SC16.38-DL2 | 147 | SC16.107-DL2 | 178 | SC16.142-DL2 |
| 117 | SC16.41-DL2 | 148 | SC16.108-DL2 | 179 | SC16.143-DL2 |
| 118 | SC16.42-DL2 | 149 | SC16.109-DL2 | 180 | SC16.144-DL2 |
| 119 | SC16.45-DL2 | 150 | SC16.110-DL2 | 181 | SC16.147-DL2 |
| 120 | SC16.47-DL2 | 151 | SC16.111-DL2 | 182 | SC16.148-DL2 |
| 121 | SC16.49-DL2 | 152 | SC16.113-DL2 | 183 | SC16.149-DL2 |
| 122 | SC16.50-DL2 | 153 | SC16.114-DL2 | 184 | SC16.150-DL2 |
| 123 | SC16.52-DL2 | 154 | SC16.115-DL2 | | |

FIG. 6 cont.

Exemplary Antibody Drug Conjugates

| ADC # | | ADC # | | ADC # | |
|---|---|---|---|---|---|
| 185 | SC16.3-DL3 | 216 | SC16.55-DL3 | 247 | SC16.116-DL3 |
| 186 | SC16.4-DL3 | 217 | SC16.56-DL3 | 248 | SC16.117-DL3 |
| 187 | SC16.5-DL3 | 218 | SC16.57-DL3 | 249 | SC16.118-DL3 |
| 188 | SC16.7-DL3 | 219 | SC16.58-DL3 | 250 | SC16.120-DL3 |
| 189 | SC16.8-DL3 | 220 | SC16.61-DL3 | 251 | SC16.121-DL3 |
| 190 | SC16.10-DL3 | 221 | SC16.62-DL3 | 252 | SC16.122-DL3 |
| 191 | SC16.11-DL3 | 222 | SC16.63-DL3 | 253 | SC16.123-DL3 |
| 192 | SC16.13-DL3 | 223 | SC16.65-DL3 | 254 | SC16.124-DL3 |
| 193 | SC16.15-DL3 | 224 | SC16.67-DL3 | 255 | SC16.125-DL3 |
| 194 | SC16.18-DL3 | 225 | SC16.68-DL3 | 256 | SC16.126-DL3 |
| 195 | SC16.19-DL3 | 226 | SC16.72-DL3 | 257 | SC16.129-DL3 |
| 196 | SC16.20-DL3 | 227 | SC16.73-DL3 | 258 | SC16.130-DL3 |
| 197 | SC16.21-DL3 | 228 | SC16.78-DL3 | 259 | SC16.131-DL3 |
| 198 | SC16.22-DL3 | 229 | SC16.79-DL3 | 260 | SC16.132-DL3 |
| 199 | SC16.23-DL3 | 230 | SC16.80-DL3 | 261 | SC16.133-DL3 |
| 200 | SC16.25-DL3 | 231 | SC16.81-DL3 | 262 | SC16.134-DL3 |
| 201 | SC16.26-DL3 | 232 | SC16.84-DL3 | 263 | SC16.135-DL3 |
| 202 | SC16.29-DL3 | 233 | SC16.88-DL3 | 264 | SC16.136-DL3 |
| 203 | SC16.30-DL3 | 234 | SC16.101-DL3 | 265 | SC16.137-DL3 |
| 204 | SC16.31-DL3 | 235 | SC16.103-DL3 | 266 | SC16.138-DL3 |
| 205 | SC16.34-DL3 | 236 | SC16.104-DL3 | 267 | SC16.139-DL3 |
| 206 | SC16.35-DL3 | 237 | SC16.105-DL3 | 268 | SC16.140-DL3 |
| 207 | SC16.36-DL3 | 238 | SC16.106-DL3 | 269 | SC16.141-DL3 |
| 208 | SC16.38-DL3 | 239 | SC16.107-DL3 | 270 | SC16.142-DL3 |
| 209 | SC16.41-DL3 | 240 | SC16.108-DL3 | 271 | SC16.143-DL3 |
| 210 | SC16.42-DL3 | 241 | SC16.109-DL3 | 272 | SC16.144-DL3 |
| 211 | SC16.45-DL3 | 242 | SC16.110-DL3 | 273 | SC16.147-DL3 |
| 212 | SC16.47-DL3 | 243 | SC16.111-DL3 | 274 | SC16.148-DL3 |
| 213 | SC16.49-DL3 | 244 | SC16.113-DL3 | 275 | SC16.149-DL3 |
| 214 | SC16.50-DL3 | 245 | SC16.114-DL3 | 276 | SC16.150-DL3 |
| 215 | SC16.52-DL3 | 246 | SC16.115-DL3 | | |

FIG. 6 cont.

Exemplary Antibody Drug Conjugates

| ADC # | | ADC # | | ADC # | |
|---|---|---|---|---|---|
| 277 | SC16.3-DL4 | 308 | SC16.55-DL4 | 339 | SC16.116-DL4 |
| 278 | SC16.4-DL4 | 309 | SC16.56-DL4 | 340 | SC16.117-DL4 |
| 279 | SC16.5-DL4 | 310 | SC16.57-DL4 | 341 | SC16.118-DL4 |
| 280 | SC16.7-DL4 | 311 | SC16.58-DL4 | 342 | SC16.120-DL4 |
| 281 | SC16.8-DL4 | 312 | SC16.61-DL4 | 343 | SC16.121-DL4 |
| 282 | SC16.10-DL4 | 313 | SC16.62-DL4 | 344 | SC16.122-DL4 |
| 283 | SC16.11-DL4 | 314 | SC16.63-DL4 | 345 | SC16.123-DL4 |
| 284 | SC16.13-DL4 | 315 | SC16.65-DL4 | 346 | SC16.124-DL4 |
| 285 | SC16.15-DL4 | 316 | SC16.67-DL4 | 347 | SC16.125-DL4 |
| 286 | SC16.18-DL4 | 317 | SC16.68-DL4 | 348 | SC16.126-DL4 |
| 287 | SC16.19-DL4 | 318 | SC16.72-DL4 | 349 | SC16.129-DL4 |
| 288 | SC16.20-DL4 | 319 | SC16.73-DL4 | 350 | SC16.130-DL4 |
| 289 | SC16.21-DL4 | 320 | SC16.78-DL4 | 351 | SC16.131-DL4 |
| 290 | SC16.22-DL4 | 321 | SC16.79-DL4 | 352 | SC16.132-DL4 |
| 291 | SC16.23-DL4 | 322 | SC16.80-DL4 | 353 | SC16.133-DL4 |
| 292 | SC16.25-DL4 | 323 | SC16.81-DL4 | 354 | SC16.134-DL4 |
| 293 | SC16.26-DL4 | 324 | SC16.84-DL4 | 355 | SC16.135-DL4 |
| 294 | SC16.29-DL4 | 325 | SC16.88-DL4 | 356 | SC16.136-DL4 |
| 295 | SC16.30-DL4 | 326 | SC16.101-DL4 | 357 | SC16.137-DL4 |
| 296 | SC16.31-DL4 | 327 | SC16.103-DL4 | 358 | SC16.138-DL4 |
| 297 | SC16.34-DL4 | 328 | SC16.104-DL4 | 359 | SC16.139-DL4 |
| 298 | SC16.35-DL4 | 329 | SC16.105-DL4 | 360 | SC16.140-DL4 |
| 299 | SC16.36-DL4 | 330 | SC16.106-DL4 | 361 | SC16.141-DL4 |
| 300 | SC16.38-DL4 | 331 | SC16.107-DL4 | 362 | SC16.142-DL4 |
| 301 | SC16.41-DL4 | 332 | SC16.108-DL4 | 363 | SC16.143-DL4 |
| 302 | SC16.42-DL4 | 333 | SC16.109-DL4 | 364 | SC16.144-DL4 |
| 303 | SC16.45-DL4 | 334 | SC16.110-DL4 | 365 | SC16.147-DL4 |
| 304 | SC16.47-DL4 | 335 | SC16.111-DL4 | 366 | SC16.148-DL4 |
| 305 | SC16.49-DL4 | 336 | SC16.113-DL4 | 367 | SC16.149-DL4 |
| 306 | SC16.50-DL4 | 337 | SC16.114-DL4 | 368 | SC16.150-DL4 |
| 307 | SC16.52-DL4 | 338 | SC16.115-DL4 | | |

FIG. 6 cont.

Exemplary Antibody Drug Conjugates

| ADC # |             | ADC # |              | ADC # |              |
|-------|-------------|-------|--------------|-------|--------------|
| 369   | SC16.3-DL5  | 400   | SC16.55-DL5  | 431   | SC16.116-DL5 |
| 370   | SC16.4-DL5  | 401   | SC16.56-DL5  | 432   | SC16.117-DL5 |
| 371   | SC16.5-DL5  | 402   | SC16.57-DL5  | 433   | SC16.118-DL5 |
| 372   | SC16.7-DL5  | 403   | SC16.58-DL5  | 434   | SC16.120-DL5 |
| 373   | SC16.8-DL5  | 404   | SC16.61-DL5  | 435   | SC16.121-DL5 |
| 374   | SC16.10-DL5 | 405   | SC16.62-DL5  | 436   | SC16.122-DL5 |
| 375   | SC16.11-DL5 | 406   | SC16.63-DL5  | 437   | SC16.123-DL5 |
| 376   | SC16.13-DL5 | 407   | SC16.65-DL5  | 438   | SC16.124-DL5 |
| 377   | SC16.15-DL5 | 408   | SC16.67-DL5  | 439   | SC16.125-DL5 |
| 378   | SC16.18-DL5 | 409   | SC16.68-DL5  | 440   | SC16.126-DL5 |
| 379   | SC16.19-DL5 | 410   | SC16.72-DL5  | 441   | SC16.129-DL5 |
| 380   | SC16.20-DL5 | 411   | SC16.73-DL5  | 442   | SC16.130-DL5 |
| 381   | SC16.21-DL5 | 412   | SC16.78-DL5  | 443   | SC16.131-DL5 |
| 382   | SC16.22-DL5 | 413   | SC16.79-DL5  | 444   | SC16.132-DL5 |
| 383   | SC16.23-DL5 | 414   | SC16.80-DL5  | 445   | SC16.133-DL5 |
| 384   | SC16.25-DL5 | 415   | SC16.81-DL5  | 446   | SC16.134-DL5 |
| 385   | SC16.26-DL5 | 416   | SC16.84-DL5  | 447   | SC16.135-DL5 |
| 386   | SC16.29-DL5 | 417   | SC16.88-DL5  | 448   | SC16.136-DL5 |
| 387   | SC16.30-DL5 | 418   | SC16.101-DL5 | 449   | SC16.137-DL5 |
| 388   | SC16.31-DL5 | 419   | SC16.103-DL5 | 450   | SC16.138-DL5 |
| 389   | SC16.34-DL5 | 420   | SC16.104-DL5 | 451   | SC16.139-DL5 |
| 390   | SC16.35-DL5 | 421   | SC16.105-DL5 | 452   | SC16.140-DL5 |
| 391   | SC16.36-DL5 | 422   | SC16.106-DL5 | 453   | SC16.141-DL5 |
| 392   | SC16.38-DL5 | 423   | SC16.107-DL5 | 454   | SC16.142-DL5 |
| 393   | SC16.41-DL5 | 424   | SC16.108-DL5 | 455   | SC16.143-DL5 |
| 394   | SC16.42-DL5 | 425   | SC16.109-DL5 | 456   | SC16.144-DL5 |
| 395   | SC16.45-DL5 | 426   | SC16.110-DL5 | 457   | SC16.147-DL5 |
| 396   | SC16.47-DL5 | 427   | SC16.111-DL5 | 458   | SC16.148-DL5 |
| 397   | SC16.49-DL5 | 428   | SC16.113-DL5 | 459   | SC16.149-DL5 |
| 398   | SC16.50-DL5 | 429   | SC16.114-DL5 | 460   | SC16.150-DL5 |
| 399   | SC16.52-DL5 | 430   | SC16.115-DL5 |       |              |

FIG. 6 cont.

Exemplary Humanized Antibody Drug Conjugates

| ADC # |              | ADC # |              | ADC # |              | ADC # |              |
|-------|--------------|-------|--------------|-------|--------------|-------|--------------|
| 461   | hSC16.13-DL1 | 466   | hSC16.13-DL2 | 471   | hSC16.13-DL3 | 476   | hSC16.13-DL4 |
| 462   | hSC16.15-DL1 | 467   | hSC16.15-DL2 | 472   | hSC16.15-DL3 | 477   | hSC16.15-DL4 |
| 463   | hSC16.25-DL1 | 468   | hSC16.25-DL2 | 473   | hSC16.25-DL3 | 478   | hSC16.25-DL4 |
| 464   | hSC16.34-DL1 | 469   | hSC16.34-DL2 | 474   | hSC16.34-DL3 | 479   | hSC16.34-DL4 |
| 465   | hSC16.56-DL1 | 470   | hSC16.56-DL2 | 475   | hSC16.56-DL3 | 480   | hSC16.56-DL4 |

| ADC # |              |
|-------|--------------|
| 481   | hSC16.13-DL5 |
| 482   | hSC16.15-DL5 |
| 483   | hSC16.25-DL5 |
| 484   | hSC16.34-DL5 |
| 485   | hSC16.56-DL5 |

FIG. 6 cont.

ANTI-DLL3 ANTIBODY DRUG CONJUGATES

CROSS REFERENCED APPLICATIONS

This application claims priority from U.S. Provisional Application No. 61/768,368 filed on Feb. 22, 2013 which is incorporated herein by reference in its entirety.

NAMES OF THE PARTIES TO A JOINT RESEARCH AGREEMENT

The claimed invention is subject to a Joint Research Agreement between Stem CentRx, Inc. and Spirogen Limited, Spirogen Developments Sárl and/or Spirogen Developments, LP. The Joint Research Agreement was in effect on and before the effective filing date of the claimed invention, and the claimed invention was made as a result of activities undertaken within the scope of the Joint Research Agreement.

SEQUENCE LISTING

The instant application contains a sequence listing which has been submitted in ASCII format via EFS-Web and is hereby incorporated by reference in its entirety. Said ASCII copy, created on Feb. 15, 2014, is named S69697_1110WO_ST25.txt and is 582 KB (596,345 bytes) in size.

FIELD OF THE INVENTION

This application generally relates to novel compounds comprising anti-DLL3 antibodies or immunoreactive fragments thereof conjugated to pyrrolobenzodiazepines (PBDs) and use of the same for the treatment or prophylaxis of cancer and any recurrence or metastasis thereof.

BACKGROUND OF THE INVENTION

Differentiation and proliferation of stem cells and progenitor cells are normal ongoing processes that act in concert to support tissue growth during organogenesis, cell repair and cell replacement. The system is tightly regulated to ensure that only appropriate signals are generated based on the needs of the organism. Cell proliferation and differentiation normally occur only as necessary for the replacement of damaged or dying cells or for growth. However, disruption of these processes can be triggered by many factors including the under- or overabundance of various signaling chemicals, the presence of altered microenvironments, genetic mutations or a combination thereof. Disruption of normal cellular proliferation and/or differentiation can lead to various disorders including proliferative diseases such as cancer.

Conventional treatments for cancer include chemotherapy, radiotherapy and immunotherapy. Often these treatments are ineffective and surgical resection may not provide a viable clinical alternative. Limitations in the current standard of care are particularly evident in those cases where patients undergo first line treatments and subsequently relapse. In such cases refractory tumors, often aggressive and incurable, frequently arise. The overall survival rates for many solid tumors have remained largely unchanged over the years due, at least in part, to the failure of existing therapies to prevent relapse, tumor recurrence and metastasis. Therapeutic constraints of currently available treatments have highlighted the need to develop new agents that effectively target tumorigenic cells and eliminate them with manageable collateral damage.

One promising area for the development of such agents and related treatments comprises targeted therapies using antibodies. In this regard antibody therapy has been established for the targeted treatment of patients with cancer, immunological and angiogenic disorders (Carter, P. (2006) Nature Reviews Immunology 6:343-357). More specifically, the use of antibody drug conjugates (i.e., ADCs or immunoconjugates) comprising a cell binding agent targeting component and a drug payload component for the localized delivery of cytotoxic or cytostatic agents has been shown to promote intracellular accumulation of the drug within the tumor cells. Such localization provides for relatively high concentrations of drug within the tumor whereas systemic administration of unconjugated (i.e., untargeted) drug to achieve the same tumor concentration may result in unacceptable levels of toxicity to normal cells (Xie et at (2006) *Expert. Opin. Biol. Ther.* 6(3):281-291; Kovtun et at (2006) *Cancer Res.* 66(6):3214-3121; Law et at (2006) *Cancer Res.* 66(4):2328-2337; Wu et at (2005) *Nature Biotech.* 23(9): 1137-1145; Lambert J. (2005) *Current Opin. in Pharmacol.* 5:543-549; Hamann P. (2005) *Expert Opin. Ther. Patents* 15(9):1087-1103; Payne, G. (2003) *Cancer Cell* 3:207-212; Trail et at (2003) *Cancer Immunol. Immunother.* 52:328-337; Syrigos and Epenetos (1999) *Anticancer Research* 19:605-614).

From a clinical standpoint such antibody drug conjugates may thereby provide enhanced efficacy with a corresponding reduction in toxicity. Efforts to design and refine ADC have focused on the selectivity of monoclonal antibodies (mAbs) as well as drug mechanism of action, conjugation techniques and linkers, drug/antibody ratio (loading) and drug-releasing properties (Junutula, et al., 2008b Nature Biotech., 26(8): 925-932; Doman et at (2009) *Blood* 114(13):2721-2729; U.S. Pat. No. 7,521,541; U.S. Pat. No. 7,723,485; WO2009/052249; McDonagh (2006) Protein Eng. Design & Sel. 19(7): 299-307; Doronina et at (2006) Bioconj. Chem. 17:114-124; Erickson et at (2006) *Cancer Res.* 66(8):1-8; Sanderson et at (2005) *Clin. Cancer Res.* 11:843-852; Jeffrey et at (2005) *J. Med. Chem.* 48:1344-1358; Hamblett et at (2004) *Clin. Cancer Res.* 10:7063-7070). With regard to antibody selectivity and tumor localization a number of known tumor markers have proved to be ineffective ADC targets for a variety of reasons including low expression, lack of internalization, shedding, etc. The selection of suitable ADC drug constituents has also proved problematic in the past. Various agents have been proposed for use in ADC including drug moieties that impart cytotoxic and cytostatic effects by mechanisms including tubulin binding, DNA binding, proteasome and/or topoisomerase inhibition.

Despite some success, certain cytotoxic drugs tend to be inactive or less active when conjugated to large antibodies or protein receptor ligands. Accordingly, selection of an appropriate targeting or cell binding agent and effective drug payload as ADC constituents are important for providing compounds exhibiting the desired clinical profile.

One class of compounds that has shown promise as potential ADC payloads are pyrrolobenzodiazepines (PBDs). In this regard PBDs have the ability to recognize and bond to specific sequences of DNA including the preferred sequence PuGPu. The first PBD antitumor antibiotic, anthramycin, was discovered in 1965 (Leimgruber, et al., *J. Am. Chem. Soc.*, 87, 5793-5795 (1965); Leimgruber, et al., *J. Am. Chem. Soc.*, 87, 5791-5793 (1965)). Since then, a number of naturally occurring PBDs have been reported, and over 10 synthetic routes have been developed to a variety of analogues (Thurston, et al., *Chem. Rev.* 1994, 433-465 (1994); Antonow, D. and Thurston, D. E., *Chem. Rev.* 2011 111 (4), 2815-2864). Family members include abbeymycin (Hochlowski, et al., *J. Antibiotics*, 40, 145-148 (1987)), chicamycin (Konishi, et al., *J. Antibiotics*, 37, 200-206 (1984)), DC-81 (Japanese Patent 58-180 487; Thurston, et al., *Chem. Brit.*, 26, 767-772 (1990); Bose, et al., *Tetrahedron*, 48, 751-758 (1992)), mazethramycin (Kuminoto, et al., *J. Antibiotics*, 33, 665-667 (1980)), neothramycins A and B (Takeuchi, et al., *J. Antibiotics*, 29, 93-96 (1976)), porothramycin (Tsunakawa, et al., *J. Antibiotics*, 41, 1366-1373 (1988)), prothracarcin (Shimizu, et al, *J. Antibiotics*, 29, 2492-2503 (1982); Langley and Thurston, *J. Org. Chem.*, 52, 91-97 (1987)), sibanomicin (DC-102)(Hara, et al., *J. Antibiotics*, 41, 702-704 (1988); Itoh, et al., *J. Antibiotics*, 41, 1281-1284 (1988)), sibiromycin (Leber, et al., *J. Am. Chem. Soc.*, 110, 2992-2993 (1988)) and tomamycin (Arima, et al., *J. Antibiotics*, 25, 437-444 (1972)).

PBDs are of the general structure:

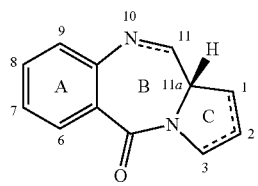

They differ in the number, type and position of substituents, in both their aromatic A rings and pyrrolo C rings, and in the degree of saturation of the C ring. In the B-ring there is either an imine (N=C), a carbinolamine (NH—CH(OH)), or a carbinolamine methyl ether (NH—CH(OMe)) at the N10-C11 position which is the electrophilic centre responsible for alkylating DNA. All of the known natural products have an (S)-configuration at the chiral C11a position which provides them with a right-handed twist when viewed from the C ring towards the A ring. This gives them the appropriate three-dimensional shape for isohelicity with the minor groove of B-form DNA, leading to a snug fit at the binding site (Kohn, In *Antibiotics III*. Springer-Verlag, New York, pp. 3-11 (1975); Hurley and Needham-VanDevanter, *Acc. Chem. Res.*, 19, 230-237 (1986)). Their ability to form an adduct in the minor groove, enables them to interfere with DNA processing, hence their use as antitumor agents.

A particularly advantageous pyrrolobenzodiazepine compound is described by Gregson et al. (*Chem. Commun.* 1999, 797-798) as compound 1, and by Gregson et al. (*J. Med. Chem.* 2001, 44, 1161-1174) as compound 4a. This compound, also known as SG2000, is shown below:

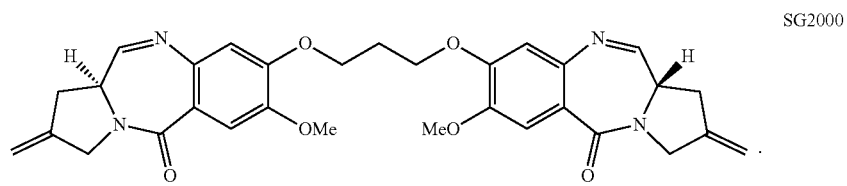

SG2000

WO 2007/085930 describes the preparation of dimer PBD compounds having linker groups for connection to a cell binding agent, such as an antibody. The linker is present in the bridge linking the monomer PBD units of the dimer.

WO 2011/130598 have describes dimer PBD compounds having linker groups for connection to a cell binding agent, such as an antibody. The linker in these compounds is attached to one of the available N10 positions and is preferably cleaved by action of an enzyme on the linker group.

While various PBD ADCs have shown promise for the treatment of certain proliferative disorders, there remains a need in the art for clinically effective targeted compounds and methods of use of such compounds to treat proliferative disorders.

SUMMARY OF THE INVENTION

These and other objectives are provided for by the present invention which, in a broad sense, is directed to methods, compounds, compositions and articles of manufacture comprising certain antibody drug conjugates comprising selected PBDs that may be used in the treatment of DLL3 associated disorders (e.g., proliferative disorders or neoplastic disorders). To that end, the present invention provides Delta-like ligand 3 (or DLL3) antibodies conjugated to selected PBDs that effectively target tumor cells and/or cancer stem cells and may be used to treat patients suffering from a wide variety of proliferative disorders and any expansion, recurrence, relapse or metastasis thereof. In a broad aspect, the present invention relates to Delta-like ligand 3 (DLL3) antibodies conjugated to selected pyrrolobenzodiazepines to provide DLL3 immunoconjugates substantially set forth in ADCs 1-5 immediately below. Accordingly, in one aspect the invention is directed to a conjugate selected from the group consisting of ADC 1
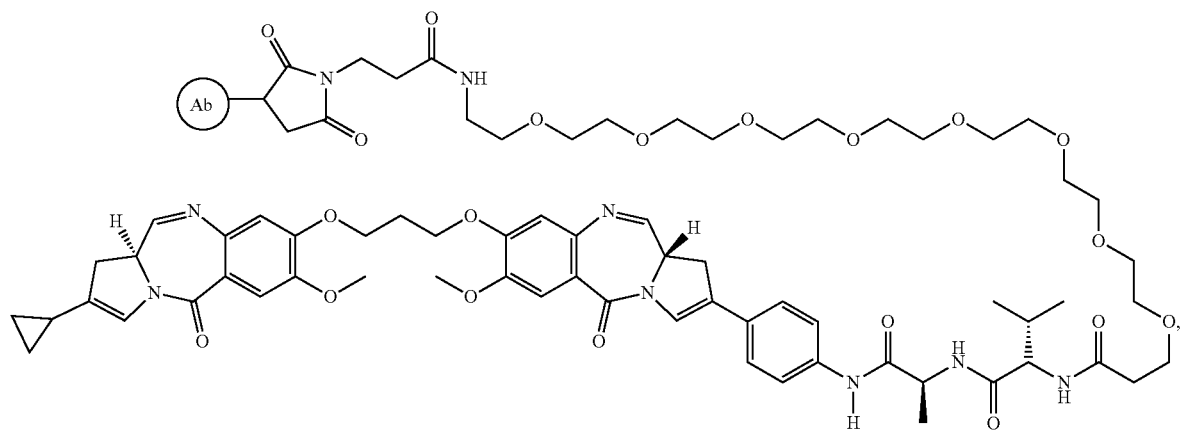
ADC 2
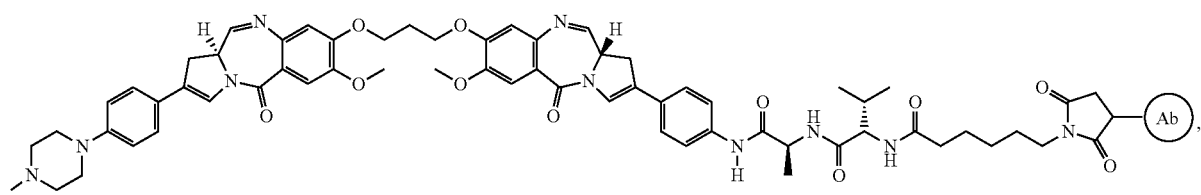
ADC 3
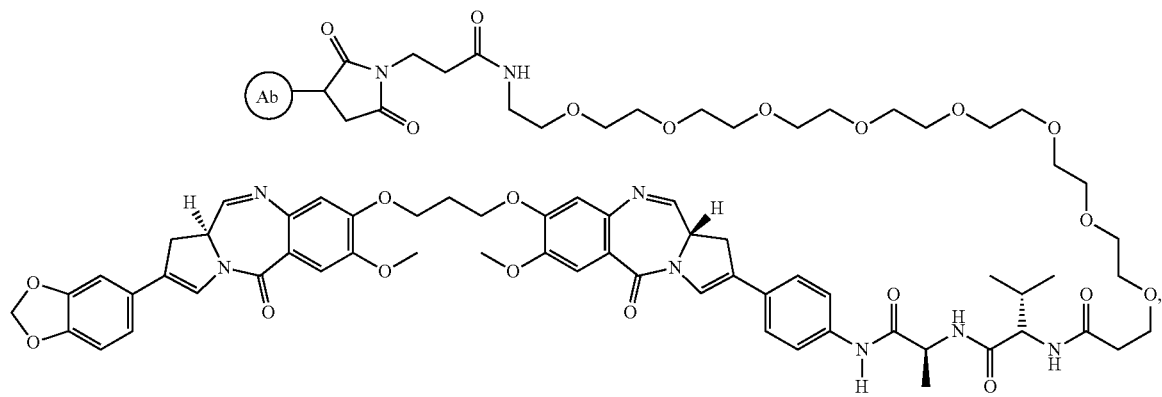
ADC 4
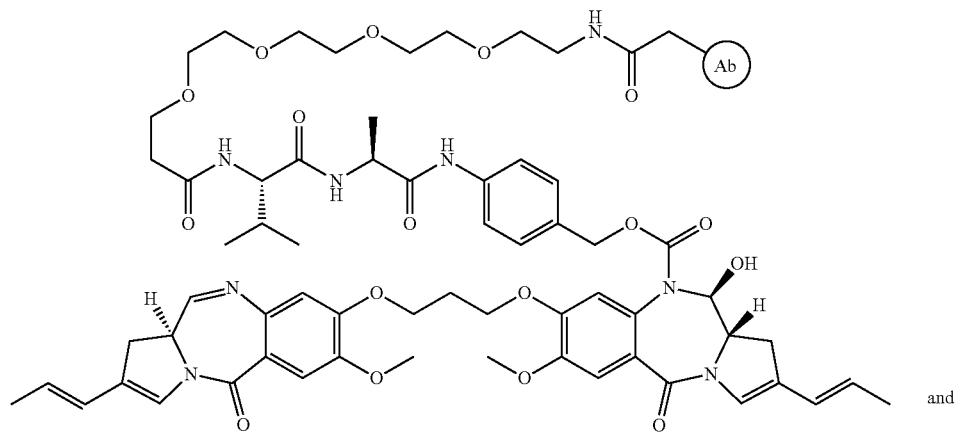
and

ADC 5

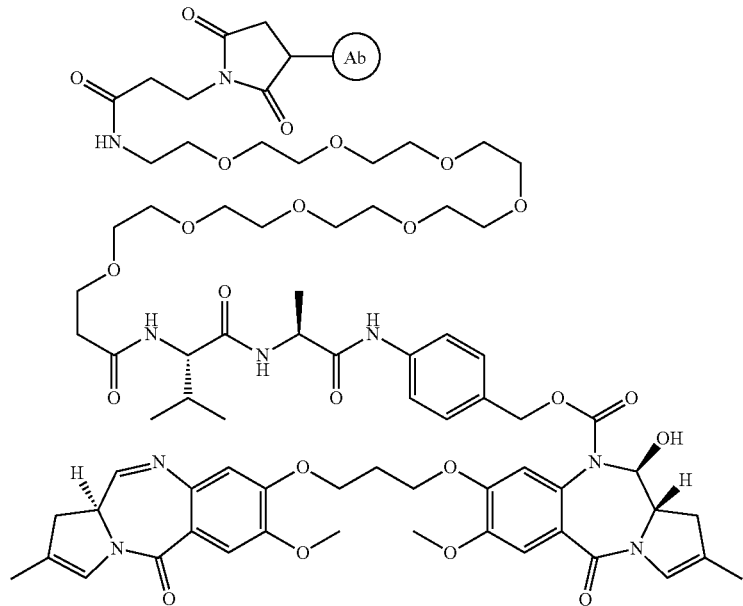

wherein Ab comprises an anti-DLL3 antibody or immunoreactive fragment thereof. Conjugation to the linker drug moiety in each of the conjugates is preferably via a free thiol on the anti-DLL3 antibody.

In other aspects the present invention comprises a composition comprising ADC 1, a composition comprising ADC 2, a composition comprising ADC 3, a composition comprising ADC 4 or a composition comprising ADC 5.

As indicated such conjugates may be used for the treatment, management, amelioration or prophylaxis of proliferative disorders or recurrence or progression thereof. Selected embodiments of the present invention provide for the use of such DLL3 conjugates, for the immunotherapeutic treatment of malignancies preferably comprising a reduction in tumor initiating cell frequency. The disclosed ADCs may be used alone or in conjunction with a wide variety of anti-cancer compounds such as chemotherapeutic or immunotherapeutic agents (e.g., therapeutic antibodies) or biological response modifiers. In other selected embodiments, two or more discrete DLL3 antibody drug conjugates may be used in combination to provide enhanced anti-neoplastic effects.

In another aspect, set forth in the appended Examples, the invention provides a method of making ADCs 1-5 comprising conjugating a compound selected from the group consisting of

DL1

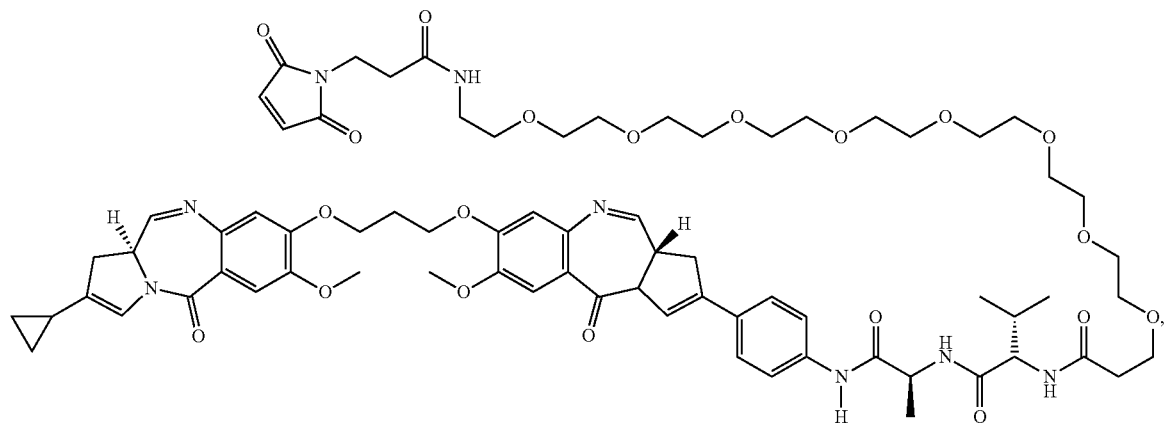

-continued
DL2
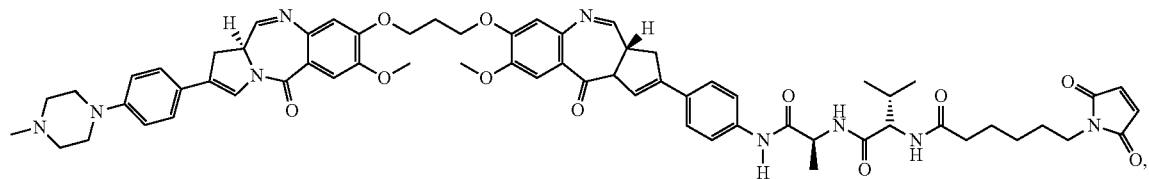
DL3
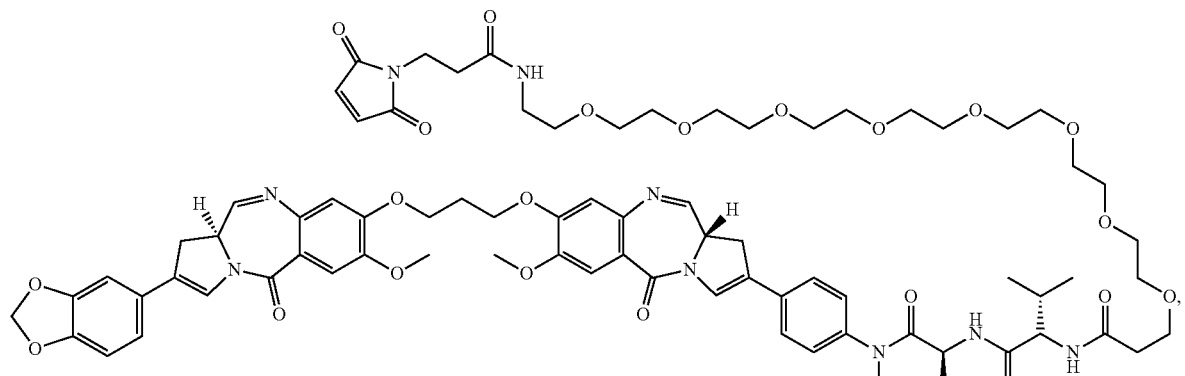
DL4
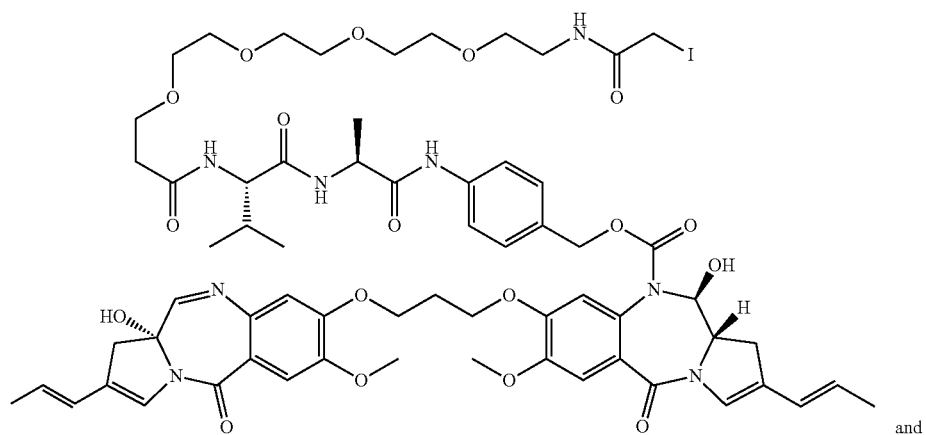
and
DL5
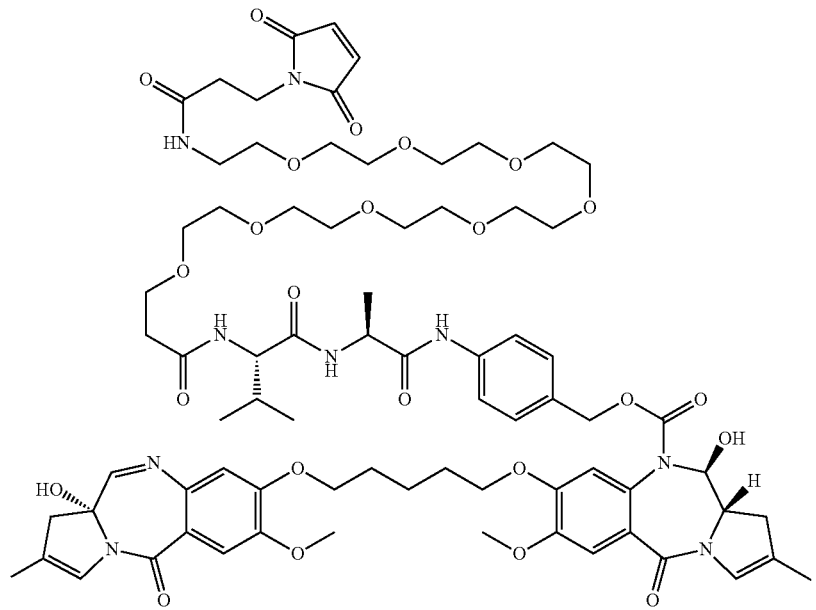

with an anti-DLL3 antibody or immunoreactive fragment thereof. For the purposes of then instant application DL will be used as an abbreviation for "drug-linker" and will comprise drug linkers 1-5 (i.e., DL1, DL2, DL3, DL4 and DL5) as set forth above.

It will be appreciated that the linker appended terminal maleimido moiety (DL1-DL3 and DL5) or iodoacetamide moiety (DL4) may be conjugated to free sulfhydryl(s) on the selected DLL3 antibody using art-recognized techniques. In addition to being discussed in more detail below, the synthetic route to each compound of DL 1-5 is provided in Example 1 appended hereto while specific methods of conjugating such compounds to provide the ADCs 1-5 are set forth in Example 7.

Note that, for the purposes of the instant application it will be appreciated that the terms "modulator" and "antibody" may be used interchangeably unless otherwise dictated by context. Similarly, the terms "anti-DLL3 conjugate" and "DLL3 conjugate", or simply "conjugate", all refer to the compounds set forth as ADCs 1-5 comprising an anti-DLL3 antibody and may be used interchangeably unless otherwise dictated by context.

In any event these and other objectives are provided for by the present invention which, in a broad sense, is directed to the aforementioned DLL3 conjugates and associated methods, compositions and articles of manufacture that may be used in the treatment of DLL3 associated disorders (e.g., proliferative disorders or neoplastic disorders). To that end, the present invention provides novel Delta-like ligand 3 (or DLL3) antibody conjugates that effectively target tumor cells and/or cancer stem cells and may be used to treat patients suffering from a wide variety of malignancies. As will be discussed in more detail herein, there are at least two naturally occurring DLL3 isoforms or variants and the disclosed modulators may comprise or associate selectively with one isoform or the other or with both. Moreover, in certain embodiments the disclosed DLL3 modulators may further react with one or more DLL family members (e.g., DLL1 or DLL4) or, in other embodiments, may be generated and selected for so as to exclusively associate or react with one or more DLL3 isoforms.

It will further be appreciated that the disclosed antibody drug conjugates may comprise any modulator, antibody or immunoreactive fragment thereof that recognizes, competes, agonizes, antagonizes, interacts, binds or associates with a DLL3 determinant (or fragment thereof) and modulates, adjusts, alters, regulates, changes or modifies the impact of the DLL3 protein on one or more physiological pathways and/or inhibits or eliminates DLL3 associated cells. Thus, in a broad sense the present invention is generally directed to DLL3 conjugates and uses thereof. Moreover, as discussed extensively below, such antibody drug conjugates may be used to provide pharmaceutical compositions useful for the prophylaxis, diagnosis or treatment of proliferative disorders including cancer.

With regard to ADCs 1-5 it will be appreciated that compatible antibodies may take on any one of a number of forms including, for example, polyclonal and monoclonal antibodies, chimeric, CDR grafted, humanized and human antibodies and immunoreactive fragments and/or variants of each of the foregoing. Preferred embodiments will comprise antibodies that are relatively non-immunogenic such as humanized or fully human constructs. Of course, in view of the instant disclosure those skilled in the art could readily identify one or more complementarity determining regions (CDRs) associated with heavy and light chain variable regions of DLL3 antibody modulators and use those CDRs to engineer or fabricate chimeric, humanized or CDR grafted antibodies without undue experimentation. Accordingly, in certain preferred embodiments the DLL3 antibody component of the disclosed ADCs comprises an antibody that incorporates one or more complementarity determining regions (CDRs) as defined in FIGS. 3A and 3B and derived from exemplary contiguous light (FIG. 3A) or heavy (FIG. 3B) chain murine variable regions (SEQ ID NOS: 21-387, odd numbers) set forth therein. Exemplary humanized (CDR grafted) light and heavy chain variable region sequences are also shown in FIG. 3 comprising SEQ ID NOS: 389-407. In preferred embodiments antibodies comprising CDRs set forth in FIGS. 3A and 3B will comprise monoclonal antibodies and, in even more preferred embodiments, will comprise chimeric, CDR grafted or humanized antibodies. Exemplary nucleic acid sequences encoding each of the amino acid sequences set forth in FIGS. 3A and 3B are appended hereto in the sequence listing.

In yet another embodiment, an antibody of the invention comprises heavy and light chain variable regions comprising amino acid sequences that are homologous to the amino acid sequences of the exemplary antibodies described herein, and wherein the antibodies retain the desired functional properties of the anti-DLL3 antibodies of the invention.

More particularly in selected embodiments antibodies included in any of ADCs 1-5 may comprise an antibody or immunoreactive fragment thereof having a light chain variable region and a heavy chain variable region wherein said light chain variable region comprises an amino acid sequence that is at least 60% homologous to an amino acid sequence selected from the group consisting of SEQ ID NO: 21, SEQ ID NO: 25, SEQ ID NO: 29, SEQ ID NO: 33, SEQ ID NO: 37, SEQ ID NO: 41, SEQ ID NO: 45, SEQ ID NO: 49, SEQ ID NO: 53, SEQ ID NO: 57, SEQ ID NO: 61, SEQ ID NO: 65, SEQ ID NO: 69, SEQ ID NO: 73, SEQ ID NO: 77, SEQ ID NO: 81, SEQ ID NO: 85, SEQ ID NO: 89, SEQ ID NO: 93, SEQ ID NO: 97, SEQ ID NO: 101, SEQ ID NO: 105, SEQ ID NO: 109, SEQ ID NO: 113, SEQ ID NO: 117, SEQ ID NO: 121, SEQ ID NO: 125, SEQ ID NO: 129, SEQ ID NO: 133, SEQ ID NO: 137, SEQ ID NO: 141, SEQ ID NO: 145, SEQ ID NO: 149, SEQ ID NO: 153, SEQ ID NO: 157, SEQ ID NO: 161, SEQ ID NO: 165, SEQ ID NO: 169, SEQ ID NO: 173, SEQ ID NO: 177, SEQ ID NO: 181, SEQ ID NO: 185, SEQ ID NO: 189, SEQ ID NO: 193, SEQ ID NO: 197, SEQ ID NO: 201, SEQ ID NO: 205, SEQ ID NO: 209, SEQ ID NO: 213, SEQ ID NO: 217, SEQ ID NO: 221, SEQ ID NO: 225, SEQ ID NO: 229, SEQ ID NO: 233, SEQ ID NO: 237, SEQ ID NO: 241, SEQ ID NO: 245, SEQ ID NO: 249, SEQ ID NO: 253, SEQ ID NO: 257, SEQ ID NO: 261, SEQ ID NO: 265, SEQ ID NO: 269, SEQ ID NO: 273, SEQ ID NO: 277, SEQ ID NO: 281, SEQ ID NO: 285, SEQ ID NO: 289, SEQ ID NO: 293, SEQ ID NO: 297, SEQ ID NO: 301, SEQ ID NO: 305, SEQ ID NO: 309, SEQ ID NO: 313, SEQ ID NO: 317, SEQ ID NO: 321, SEQ ID NO: 325, SEQ ID NO: 329, SEQ ID NO: 333, SEQ ID NO: 337, SEQ ID NO: 341, SEQ ID NO: 345, SEQ ID NO: 349, SEQ ID NO: 353, SEQ ID NO: 357, SEQ ID NO: 361, SEQ ID NO: 365, SEQ ID NO: 369, SEQ ID NO: 373, SEQ ID NO: 377, SEQ ID NO: 381 and SEQ ID NO: 385 and wherein said heavy chain variable region comprises an amino acid sequence that is at least 60% homologous to an amino acid sequence selected from the group consisting of SEQ ID NO: 23, SEQ ID NO: 27, SEQ ID NO: 31, SEQ ID NO: 35, SEQ ID NO: 39, SEQ ID NO: 43, SEQ ID NO: 47, SEQ ID NO: 51, SEQ ID NO: 55, SEQ ID NO: 59, SEQ ID NO: 63, SEQ ID NO: 67, SEQ ID NO: 71, SEQ ID NO: 75, SEQ ID NO: 79, SEQ ID NO: 83, SEQ ID NO: 87, SEQ ID NO: 91, SEQ ID NO: 95, SEQ ID NO: 99, SEQ ID NO: 103, SEQ ID NO: 107, SEQ ID NO: 111, SEQ ID NO: 115, SEQ ID NO: 119, SEQ ID NO: 123, SEQ ID NO: 127, SEQ ID NO: 131, SEQ ID NO: 135, SEQ ID NO: 139 SEQ ID NO: 143, SEQ ID NO: 147, SEQ ID NO: 151, SEQ ID NO: 155, SEQ ID NO: 159, SEQ ID NO: 163, SEQ ID NO: 167, SEQ ID NO: 171, SEQ ID NO: 175, SEQ ID NO: 179, SEQ ID NO: 183, SEQ ID NO: 187, SEQ ID NO: 191, SEQ ID NO: 195, SEQ ID NO: 199, SEQ ID NO: 203, SEQ ID NO: 207, SEQ ID NO: 211, SEQ ID NO: 215, SEQ ID NO: 219, SEQ ID NO: 223, SEQ ID NO: 227, SEQ ID NO: 231, SEQ ID NO: 235, SEQ ID NO: 239, SEQ ID NO: 243, SEQ ID NO: 247, SEQ ID NO: 251, SEQ ID NO: 255, SEQ ID NO: 259, SEQ ID NO: 263, SEQ ID NO: 267, SEQ ID NO: 271, SEQ ID NO: 275, SEQ ID NO: 279, SEQ ID NO: 283, SEQ ID NO: 287, SEQ ID NO: 291, SEQ ID NO: 295, SEQ ID NO: 299, SEQ ID NO: 303, SEQ ID NO: 307 SEQ ID NO: 311, SEQ ID NO: 315, SEQ ID NO: 319, SEQ ID NO: 323, SEQ ID NO: 327, SEQ ID NO: 331, SEQ ID NO: 335, SEQ ID NO: 339, SEQ ID NO: 343, SEQ ID NO: 347, SEQ ID NO: 351, SEQ ID NO: 355, SEQ ID NO: 359, SEQ ID NO: 363, SEQ ID NO: 367, SEQ ID NO: 371, SEQ ID NO: 375, SEQ ID NO: 379, SEQ ID NO: 383 and SEQ ID NO: 387. In other preferred embodiments the selected modulators will comprise heavy and light chain variable regions that are 65, 70, 75 or 80% homologous to the aforementioned murine sequences. In still other embodiments the modulators will comprise heavy and light chain variable region amino acid sequences that are 85, 90 or even 95% homologous to the disclosed murine sequences. In this regard it will be appreciated that humanized antibodies derived from murine source antibodies typically have heavy and light chain variable regions that are preferably from approximately 70% to approximately 85% homologous with regard to the source antibody. By way of comparison humanized antibodies will typically have heavy and light chain variable regions that are preferably from approximately 80% to approximately 95% homologous with those of the acceptor human antibody.

In other preferred embodiments the selected antibodies will comprise one or more CDRs obtained from any of the foregoing light and heavy chain variable region amino acid sequences. Accordingly, selected embodiments of the invention include a DLL3 modulator comprising one or more CDRs from any one of SEQ ID NOS: 21 to 387, odd numbers. Preferably the antibodies will comprise three light chain CDRs obtained from a single light chain variable region amino acid sequence set forth in FIG. 3A and three heavy chain CDRs obtained from a single heavy chain variable region amino acid sequence set forth in FIG. 3B. For example, exemplary antibodies can comprise three light chain CDDRs obtained from a single light chain variable region amino acid sequence set forth in FIG. 3A and three heavy chain CDRs from a single heavy chain variable region amino acid sequence set forth in FIG. 3B, wherein the light chain and heavy chain variable regions are from the same clone. In still other embodiments the conjugates of the instant invention will comprise any antibody or immunoreactive fragment thereof that competes for binding with any of the foregoing modulators.

Thus, another aspect of the invention comprises ADCs incorporating antibodies obtained or derived from SC16.3, SC16.4, SC16.5, SC16.7, SC16.8, SC16.10, SC16.11, SC16.13, SC16.15, SC16.18, SC16.19, SC16.20, SC16.21, SC16.22, SC16.23, SC16.25, SC16.26, SC16.29, SC16.30, SC16.31, SC16.34, SC16.35, SC16.36, SC16.38, SC16.41, SC16.42, SC16.45, SC16.47, SC16.49, SC16.50, SC16.52, SC16.55, SC16.56, SC16.57, SC16.58, SC16.61, SC16.62, SC16.63, SC16.65, SC16.67, SC16.68, SC16.72, SC16.73, SC16.78, SC16.79, SC16.80, SC16.81, SC16.84, SC16.88, SC16.101, SC16.103, SC16.104, SC16.105, SC16.106, SC16.107, SC16.108, SC16.109, SC16.110, SC16.111, SC16.113, SC16.114, SC16.115, SC16.116, SC16.117, SC16.118, SC16.120, SC16.121, SC16.122, SC16.123, SC16.124, SC16.125, SC16.126, SC16.129, SC16.130, SC16.131, SC16.132, SC16.133, SC16.134, SC16.135, SC16.136, SC16.137, SC16.138, SC16.139, SC16.140, SC16.141, SC16.142, SC16.143, SC16.144, SC16.147, SC16.148, SC16.149 and SC16.150; or any of the above-identified antibodies, or chimeric or humanized versions thereof. In other embodiments the ADCs of the invention will comprise a DLL3 antibody having one or more CDRs, for example, one, two, three, four, five, or six CDRs, from any of the aforementioned modulators.

In another aspect the present invention will comprise a conjugate wherein the anti-DLL3 antibody or immunoreactive fragment thereof comprises a light chain variable region and a heavy chain variable region wherein said light chain variable region comprises an amino acid sequence derived from an amino acid sequence selected from the group consisting of SEQ ID NO: 21, SEQ ID NO: 25, SEQ ID NO: 29, SEQ ID NO: 33, SEQ ID NO: 37, SEQ ID NO: 41, SEQ ID NO: 45, SEQ ID NO: 49, SEQ ID NO: 53, SEQ ID NO: 57, SEQ ID NO: 61, SEQ ID NO: 65, SEQ ID NO: 69, SEQ ID NO: 73, SEQ ID NO: 77, SEQ ID NO: 81, SEQ ID NO: 85, SEQ ID NO: 89, SEQ ID NO: 93, SEQ ID NO: 97, SEQ ID NO: 101, SEQ ID NO: 105, SEQ ID NO: 109, SEQ ID NO: 113, SEQ ID NO: 117, SEQ ID NO: 121, SEQ ID NO: 125, SEQ ID NO: 129, SEQ ID NO: 133, SEQ ID NO: 137, SEQ ID NO: 141, SEQ ID NO: 145, SEQ ID NO: 149, SEQ ID NO: 153, SEQ ID NO: 157, SEQ ID NO: 161, SEQ ID NO: 165, SEQ ID NO: 169, SEQ ID NO: 173, SEQ ID NO: 177, SEQ ID NO: 181, SEQ ID NO: 185, SEQ ID NO: 189, SEQ ID NO: 193, SEQ ID NO: 197, SEQ ID NO: 201, SEQ ID NO: 205, SEQ ID NO: 209, SEQ ID NO: 213, SEQ ID NO: 217, SEQ ID NO: 221, SEQ ID NO: 225, SEQ ID NO: 229, SEQ ID NO: 233, SEQ ID NO: 237, SEQ ID NO: 241, SEQ ID NO: 245, SEQ ID NO: 249, SEQ ID NO: 253, SEQ ID NO: 257, SEQ ID NO: 261, SEQ ID NO: 265, SEQ ID NO: 269, SEQ ID NO: 273, SEQ ID NO: 277, SEQ ID NO: 281, SEQ ID NO: 285, SEQ ID NO: 289, SEQ ID NO: 293, SEQ ID NO: 297, SEQ ID NO: 301, SEQ ID NO: 305, SEQ ID NO: 309, SEQ ID NO: 313, SEQ ID NO: 317, SEQ ID NO: 321, SEQ ID NO: 325, SEQ ID NO: 329, SEQ ID NO: 333, SEQ ID NO: 337, SEQ ID NO: 341, SEQ ID NO: 345, SEQ ID NO: 349, SEQ ID NO: 353, SEQ ID NO: 357, SEQ ID NO: 361, SEQ ID NO: 365, SEQ ID NO: 369, SEQ ID NO: 373, SEQ ID NO: 377, SEQ ID NO: 381 and SEQ ID NO: 385 and wherein said heavy chain variable region comprises an amino acid sequence derived from an amino acid sequence selected from the group consisting of SEQ ID NO: 23, SEQ ID NO: 27, SEQ ID NO: 31, SEQ ID NO: 35, SEQ ID NO: 39, SEQ ID NO: 43, SEQ ID NO: 47, SEQ ID NO: 51, SEQ ID NO: 55, SEQ ID NO: 59, SEQ ID NO: 63, SEQ ID NO: 67, SEQ ID NO: 71, SEQ ID NO: 75, SEQ ID NO: 79, SEQ ID NO: 83, SEQ ID NO: 87, SEQ ID NO: 91, SEQ ID NO: 95, SEQ ID NO: 99, SEQ ID NO: 103, SEQ ID NO: 107, SEQ ID NO: 111, SEQ ID NO: 115, SEQ ID NO: 119, SEQ ID NO: 123, SEQ ID NO: 127, SEQ ID NO: 131, SEQ ID NO: 135, SEQ ID NO: 139 SEQ ID NO: 143, SEQ ID NO: 147, SEQ ID NO: 151, SEQ ID NO: 155, SEQ ID NO: 159, SEQ ID NO: 163, SEQ ID NO: 167, SEQ ID NO: 171, SEQ ID NO: 175, SEQ ID NO: 179, SEQ ID NO: 183, SEQ ID NO: 187, SEQ ID NO: 191, SEQ ID NO: 195, SEQ ID NO: 199, SEQ ID NO: 203, SEQ ID NO: 207, SEQ ID NO: 211, SEQ ID NO: 215, SEQ ID NO: 219, SEQ ID NO: 223, SEQ ID NO: 227, SEQ ID NO: 231, SEQ ID NO: 235, SEQ ID NO: 239, SEQ ID NO: 243, SEQ ID NO: 247, SEQ ID NO: 251, SEQ ID NO: 255, SEQ ID NO: 259, SEQ ID NO: 263, SEQ ID NO: 267, SEQ ID NO: 271, SEQ ID NO: 275, SEQ ID NO: 279, SEQ ID NO: 283, SEQ ID NO: 287, SEQ ID NO: 291, SEQ ID NO: 295, SEQ ID NO: 299, SEQ ID NO: 303, SEQ ID NO: 307 SEQ ID NO: 311, SEQ ID NO: 315, SEQ ID NO: 319, SEQ ID NO: 323, SEQ ID NO: 327, SEQ ID NO: 331, SEQ ID NO: 335, SEQ ID NO: 339, SEQ ID NO: 343, SEQ ID NO: 347, SEQ ID NO: 351, SEQ ID NO: 355, SEQ ID NO: 359, SEQ ID NO: 363, SEQ ID NO: 367, SEQ ID NO: 371, SEQ ID NO: 375, SEQ ID NO: 379, SEQ ID NO: 383 and SEQ ID NO: 387. For example, such antibodies can include a light chain variable region and a heavy chain variable region of a same clone identified in FIGS. 3A and 3B.

In yet other compatible embodiments the antibody drug conjugates of the instant invention will comprise one of the CDR grafted or humanized DLL3 antibodies hSC16.13, hSC16.15, hSC16.25, hSC16.34 and hSC16.56.

Other embodiments are directed to ADCs comprising an antibody wherein said antibody comprises:

an antibody light chain comprising a light chain variable region CDR1 comprising SEQ ID NO: 408, a light chain variable region CDR2 comprising SEQ ID NO: 409 and a light chain variable region CDR3 comprising SEQ ID NO: 410; and an antibody heavy chain comprising a heavy chain variable region CDR1 comprising SEQ ID NO: 411, a heavy chain variable region CDR2 comprising SEQ ID NO: 412 and a heavy chain variable region CDR3 comprising SEQ ID NO: 413.

In another embodiment the invention is directed to ADCs comprising an antibody wherein said antibody comprises:

an antibody light chain comprising a light chain variable region CDR1 comprising SEQ ID NO: 414, a light chain variable region CDR2 comprising SEQ ID NO: 415 and a light chain variable region CDR3 comprising SEQ ID NO: 416; and an antibody heavy chain comprising a heavy chain variable region CDR1 comprising SEQ ID NO: 417, a heavy chain variable region CDR2 comprising SEQ ID NO: 418 and a heavy chain variable region CDR3 comprising SEQ ID NO: 419.

In another embodiment the invention is directed to ADCs comprising an antibody wherein said antibody comprises:

an antibody light chain comprising a light chain variable region CDR1 comprising SEQ ID NO: 420, a light chain variable region CDR2 comprising SEQ ID NO: 421 and a light chain variable region CDR3 comprising SEQ ID NO: 422; and an antibody heavy chain comprising a heavy chain variable region CDR1 comprising SEQ ID NO: 423, a heavy chain variable region CDR2 comprising SEQ ID NO: 424 and a heavy chain variable region CDR3 comprising SEQ ID NO: 425.

In another embodiment the invention is directed to ADCs comprising an antibody wherein said antibody comprises:

an antibody light chain comprising a light chain variable region CDR1 comprising SEQ ID NO: 426, a light chain variable region CDR2 comprising SEQ ID NO: 427 and a light chain variable region CDR3 comprising SEQ ID NO: 428; and an antibody heavy chain comprising a heavy chain variable region CDR1 comprising SEQ ID NO: 429, a heavy chain variable region CDR2 comprising SEQ ID NO: 430 and a heavy chain variable region CDR3 comprising SEQ ID NO: 431.

In another embodiment the invention is directed to ADCs comprising an antibody wherein said antibody comprises:

an antibody light chain comprising a light chain variable region CDR1 comprising SEQ ID NO: 432, a light chain variable region CDR2 comprising SEQ ID NO: 433 and a light chain variable region CDR3 comprising SEQ ID NO: 434; and an antibody heavy chain comprising a heavy chain variable region CDR1 comprising SEQ ID NO: 435, a heavy chain variable region CDR2 comprising SEQ ID NO: 436 and a heavy chain variable region CDR3 comprising SEQ ID NO: 437.

In certain preferred embodiments each of the aforementioned antibodies comprises humanized antibodies. Moreover, as described herein nucleic acid sequences encoding such exemplary humanized heavy and light chain variable regions are set forth in the attached sequence listing.

In addition one aspect of the invention may comprise the therapeutic association of DLL3 polypeptides with cancer stem cells. Thus, in certain other embodiments the invention will comprise a DLL3 conjugate of ADCs 1-5 that reduces the frequency of tumor initiating cells upon administration to a subject. Preferably the reduction in frequency will be determined using in vitro or in vivo limiting dilution analysis. In particularly preferred embodiments such analysis may be conducted using in vivo limiting dilution analysis comprising transplant of live human tumor cells into immunocompromised mice. Alternatively, the limiting dilution analysis may be conducted using in vitro limiting dilution analysis comprising limiting dilution deposition of live human tumor cells into in vitro colony supporting conditions. In either case, the analysis, calculation or quantification of the reduction in frequency will preferably comprise the use of Poisson distribution statistics to provide an accurate accounting. It will be appreciated that, while such quantification methods are preferred, other, less labor intensive methodologies such as flow cytometry or immunohistochemistry may also be used to provide the desired values and, accordingly, are expressly contemplated as being within the scope of the instant invention. In such cases the reduction in frequency may be determined using flow cytometric analysis or immunohistochemical detection of tumor cell surface markers known to enrich for tumor initiating cells.

In this regard it will be appreciated that the present invention is based, at least in part, upon the discovery that DLL3 immunogens are therapeutically associated with tumor perpetuating cells (i.e., cancer stem cells) that are involved in the etiology of various proliferative disorders including neoplasia. More specifically, the instant application discloses that administration of the disclosed DLL3 conjugates can mediate, reduce, deplete, inhibit or eliminate tumorigenic signaling by tumor initiating cells (e.g., reduce the frequency of tumor initiating cells). This reduced signaling, whether by depletion, neutralization, reduction, elimination, reprogramming or silencing of the tumor initiating cells or by modifying tumor cell morphology (e.g., induced differentiation, niche disruption), in turn allows for the more effective treatment of DLL3 associated disorders by inhibiting tumorigenesis, tumor maintenance, expansion and/or metastasis and recurrence.

Besides the aforementioned association with cancer stem cells, there is evidence that DLL3 isoforms may be implicated in the growth, recurrence or metastatic potential of tumors comprising or exhibiting neuroendocrine features or phenotypic determinants. For the purposes of the instant invention such tumors will comprise neuroendocrine tumors and pseudo neuroendocrine tumors. Intervention in the proliferation of such tumorigenic cells using the novel DLL3 conjugates described herein, may thereby ameliorate or treat a disorder by more than one mechanism (e.g., tumor initiating cell reduction and disruption of oncogenic pathway signaling) to provide additive or synergistic effects. Still other preferred embodiments may take advantage of the cellular internalization of cell surface DLL3 protein to deliver the attached anti-cancer agent. In this regard it will be appreciated that the present invention is not limited by any particular mechanism of action but rather encompasses the broad use of the disclosed modulators to treat DLL3 associated disorders (including various neoplasia).

In yet other preferred embodiments the modulators will associate or bind to a specific epitope, portion, motif or domain of DLL3. As will be discussed in some detail below, both DLL3 isoforms incorporate an identical extracellular region (see FIG. 2) comprising at least an N-terminal domain, a DSL (Delta/Serrate/lag-2) domain and six EGF-like domains (i.e., EGF1 EGF6). Accordingly, in certain embodiments the modulators will bind or associate with the N-terminal domain of DLL3 (i.e. amino acids 27-175 in the mature protein) while in other selected embodiments the modulators will associate with the DSL domain (i.e. amino acids 176-215 of DLL3) or epitope therein. Other aspects of the instant invention comprise antibodies that associate or bind to a specific epitope located in a particular EGF-like domain of DLL3. In this regard the particular modulator may associate or bind to an epitope located in EGF1 (amino acids 216-249), EGF2 (amino acids 274-310), EGF3 (amino acids 312-351), EGF4 (amino acids 353-389), EGF5 (amino acids 391-427) or EGF6 (amino acids 429-465). Of course it will be appreciated that each of the aforementioned domains may comprise more than one epitope and/or more than one bin. In particularly preferred embodiments the invention will comprise an antibody that binds, reacts or associates with the DSL domain or an epitope therein. In other preferred embodiments the invention will comprise antibodies that bind, react or associate with a particular EGF-like domain or an epitope therein. In yet other preferred embodiments the modulators will bind, react or associate with the N-terminal domain or an epitope therein.

With regard to modulator or antibody "bins" it will be appreciated that the DLL3 antigen may be analyzed or mapped through competitive antibody binding using art-recognized techniques to define specific bins located on or along the protein. While discussed in more detail herein and shown in the Examples below, two antibodies (one of which may be termed a "reference antibody," "bin delineating antibody" or "delineating antibody") may be considered to be in the same bin if they compete with each other for binding to the target antigen. In such cases the subject antibody epitopes may be identical, substantially identical or close enough (either in a linear sense where they are separated by a few amino acids or conformationally) so that both antibodies are sterically or electrostatically inhibited or precluded from binding to the antigen. Such defined bins may be generally associated with certain DLL3 domains (e.g. the reference antibody will bind with an epitope contained in a specific domain) though the correlation is not always precise (e.g., there may be more than one bin in a domain or the bin may be defined conformationally and comprise more than one domain). It will be appreciated that those skilled in the art can readily determine the relationship between the DLL3 domains and empirically determined bins.

With regard to the present invention competitive binding analysis using art-recognized techniques (e.g., ELISA, surface plasmon resonance or bio-layer interferometry) defined at least nine distinct bins, each of which was found to contain a number of antibody modulators. For the purposes of the instant disclosure the nine bins were termed bin A to bin I. Thus, in selected embodiments the present invention will comprise an antibody drug conjugate of ADCs 1-5 residing in a bin selected from the group consisting of bin A, bin B, bin C, bin D, bin E, bin F, bin G, bin H and bin I.

In other embodiments the conjugates of the present invention comprise an antibody residing in a bin defined by a reference antibody selected from the group consisting of SC16.3, SC16.4, SC16.5, SC16.7, SC16.8, SC16.10, SC16.11, SC16.13, SC16.15, SC16.18, SC16.19, SC16.20, SC16.21, SC16.22, SC16.23, SC16.25, SC16.26, SC16.29, SC16.30, SC16.31, SC16.34, SC16.35, SC16.36, SC16.38, SC16.41, SC16.42, SC16.45, SC16.47, SC16.49, SC16.50, SC16.52, SC16.55, SC16.56, SC16.57, SC16.58, SC16.61, SC16.62, SC16.63, SC16.65, SC16.67, SC16.68, SC16.72, SC16.73, SC16.78, SC16.79, SC16.80, SC16.81, SC16.84, SC16.88, SC16.101, SC16.103, SC16.104, SC16.105, SC16.106, SC16.107, SC16.108, SC16.109, SC16.110, SC16.111, SC16.113, SC16.114, SC16.115, SC16.116, SC16.117, SC16.118, SC16.120, SC16.121, SC16.122, SC16.123, SC16.124, SC16.125, SC16.126, SC16.129, SC16.130, SC16.131, SC16.132, SC16.133, SC16.134, SC16.135, SC16.136, SC16.137, SC16.138, SC16.139, SC16.140, SC16.141, SC16.142, SC16.143, SC16.144, SC16.147, SC16.148, SC16.149 and SC16.150. In still other embodiments the ADCs of the invention will comprise antibodies from bin A, antibodies from bin B, antibodies from bin C, antibodies from bin D, antibodies from bin E, antibodies from bin F, antibodies from bin G, antibodies from bin H or antibodies from bin I. Yet other preferred embodiments will comprise a reference antibody modulator and any antibody that competes with the reference antibody.

The term "compete" or "competing antibody" when used in the context of the disclosed modulators means binding competition between antibodies as determined by an assay in which a reference antibody or immunologically functional fragment substantially prevents or inhibits (e.g., greater than 30%, 35%, 40%, 45%, 50%, 55%, 60%, 65%, 70%, 75%, 80%, 85% or 90%) specific binding of a test antibody to a common antigen. Compatible methods for determining such competition comprise art known techniques such as, for example, bio-layer interferometry, surface plasmon resonance, flow cytometry, competitive ELISA, etc.

The present invention also provides kits or devices and associated methods that employ the DLL3 conjugates disclosed herein, and pharmaceutical compositions of DLL3 conjugates as disclosed herein, which are useful for the treatment of DLL3 associated disorders such as cancer. To this end the present invention preferably provides an article of manufacture useful for treating DLL3 associated disorders comprising a receptacle containing an antibody drug conjugate of ADCs 1-5 and instructional materials for using the conjugates to treat, ameliorate or prevent a DLL3 associated disorder or progression or recurrence thereof.

The foregoing is a summary and thus contains, by necessity, simplifications, generalizations, and omissions of detail; consequently, those skilled in the art will appreciate that the summary is illustrative only and is not intended to be in any way limiting. Other aspects, features, and advantages of the methods, compositions and/or devices and/or other subject matter described herein will become apparent in the teachings set forth herein. The summary is provided to introduce a selection of concepts in a simplified form that are further described below in the Detailed Description. This summary is not intended to identify key features or essential features of the claimed subject matter, nor is it intended to be used as an aid in determining the scope of the claimed subject matter.

BRIEF DESCRIPTION OF THE FIGURES

FIG. 1 provides a sequence alignment of the two isoforms of the DLL3 protein (SEQ ID NOS: 1 and 2).

FIGS. 3A and 3B provide, in a tabular form, contiguous amino acid sequences (SEQ ID NOS: 21-407, odd numbers) of light and heavy chain variable regions of a number of murine and humanized exemplary DLL3 antibodies compatible with the disclosed antibody drug conjugates as isolated, cloned and engineered as described in the Examples herein.

FIG. 5 sets forth biochemical and immunological properties of exemplary DLL3 modulators as represented in a tabular format.

FIG. 6 provides a listing of exemplary antibody drug conjugates generated as per the instant disclosure.

DETAILED DESCRIPTION OF THE INVENTION

I. Introduction

Figure 2:
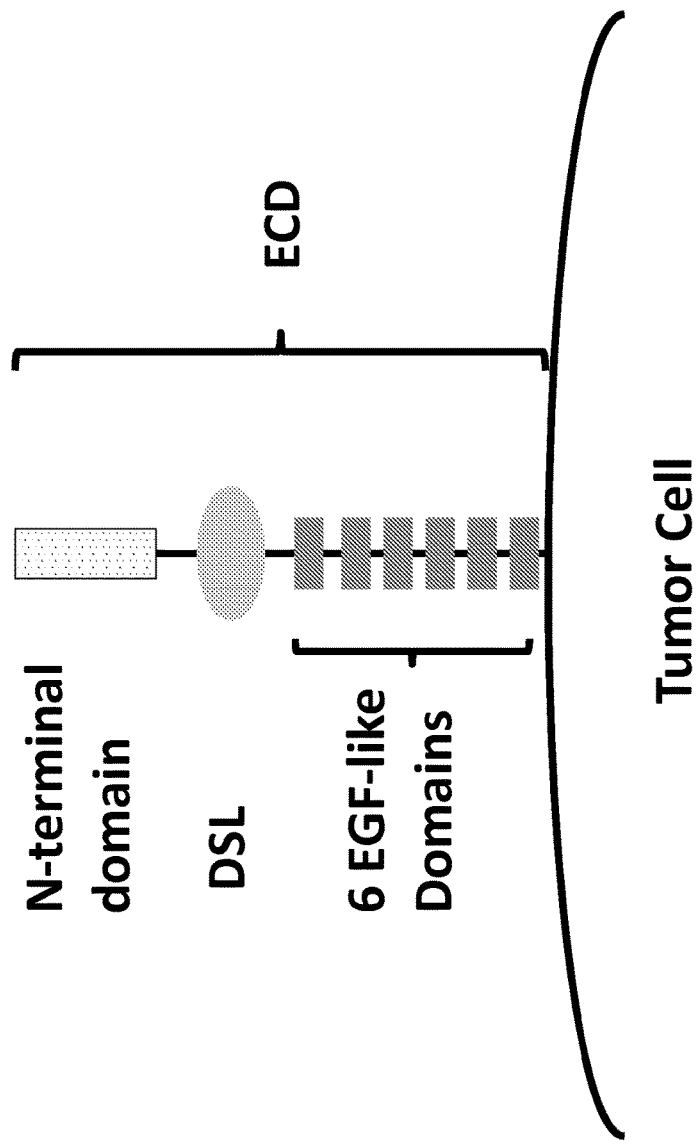
FIG. 2 provides a schematic representation of the extracellular region of DLL3 protein illustrating the positions of the various domains.

While the present invention may be embodied in many different forms, disclosed herein are specific illustrative embodiments thereof that exemplify the principles of the invention. It should be emphasized that the present invention is not limited to the specific embodiments illustrated. Moreover, any section headings used herein are for organizational purposes only and are not to be construed as limiting the subject matter described. Finally, for the purposes of the instant disclosure all identifying sequence Accession numbers may be found in the NCBI Reference Sequence (RefSeq) database and/or the NCBI GenBank® archival sequence database unless otherwise noted.

As discussed above it has been found that DLL3 phenotypic determinants are clinically associated with various proliferative disorders, including neoplasia exhibiting neuroendocrine features, and that DLL3 protein and variants or isoforms thereof provide useful tumor markers which may be exploited in the treatment of related diseases. In this regard the present invention provides a number of antibody drug conjugates set forth as ADCs 1-5 above that comprise an anti-DLL3 antibody targeting agent and PBD payload. As discussed in more detail below and set forth in the appended Examples, the disclosed DLL3 ADCs are particularly effective at eliminating tumorigenic cells and therefore useful for the treatment and prophylaxis of certain proliferative disorders or the progression or recurrence thereof.

Moreover, as shown in the instant application it has been found that DLL3 markers or determinants such as cell surface DLL3 protein are therapeutically associated with cancer stem cells (also known as tumor perpetuating cells) and may be effectively exploited to eliminate or silence the same. The ability to selectively reduce or eliminate cancer stem cells through the use of conjugated DLL3 modulators as disclosed herein is surprising in that such cells are known to generally be resistant to many conventional treatments. That is, the effectiveness of traditional, as well as more recent targeted treatment methods, is often limited by the existence and/or emergence of resistant cancer stem cells that are capable of perpetuating tumor growth even in face of these diverse treatment methods. Further, determinants associated with cancer stem cells often make poor therapeutic targets due to low or inconsistent expression, failure to remain associated with the tumorigenic cell or failure to present at the cell surface. In sharp contrast to the teachings of the prior art, the instantly disclosed antibody drug conjugates and methods effectively overcome this inherent resistance and to specifically eliminate, deplete, silence or promote the differentiation of such cancer stem cells thereby negating their ability to sustain or re-induce the underlying tumor growth. Moreover, as expression of DLL3 protein has largely been associated with intracellular locations such as the Golgi, it was uncertain that such phenotypic determinants could be successfully exploited as a therapeutic target for the specific ADCs as taught herein.

Thus, it is particularly remarkable that DLL3 conjugates such as those disclosed herein may advantageously be used in the treatment and/or prevention of selected proliferative (e.g., neoplastic) disorders or progression or recurrence thereof. It will be appreciated that, while preferred embodiments of the invention will be discussed extensively below, particularly in terms of particular domains, regions or epitopes or in the context of cancer stem cells or tumors comprising neuroendocrine features and their interactions with the disclosed antibody drug conjugates, those skilled in the art will appreciate that the scope of the instant invention is not limited by such exemplary embodiments. Rather, the most expansive embodiments of the present invention and the appended claims are broadly and expressly directed to the disclosed DLL3 conjugates and their use in the treatment and/or prevention of a variety of DLL3 associated or mediated disorders, including neoplastic or cell proliferative disorders, regardless of any particular mechanism of action or specifically targeted tumor, cellular or molecular component.

To that end, and as demonstrated in the instant application, it has unexpectedly been found that the disclosed DLL3 conjugates can effectively be used to target and eliminate or otherwise incapacitate proliferative or tumorigenic cells and treat DLL3 associated disorders (e.g., neoplasia). As used herein a "DLL3 associated disorder" shall be held to mean any disorder or disease (including proliferative disorders) that is marked, diagnosed, detected or identified by a phenotypic aberration of DLL3 genetic components or expression ("DLL3 determinant") during the course or etiology of the disease or disorder. In this regard a DLL3 phenotypic aberration or determinant may, for example, comprise elevated or depressed levels of DLL3 protein expression, abnormal DLL3 protein expression on certain definable cell populations or abnormal DLL3 protein expression at an inappropriate phase or stage of a cell lifecycle. Of course, it will be appreciated that similar expression patterns of genotypic determinants (e.g., mRNA transcription levels) of DLL3 may also be used to classify, detect or treat DLL3 disorders.

With regard to the disclosed conjugates the present invention provides PBD dimers with a linker connected to a position on one of the PBD moieties and conjugated via the linker to a DLL3 antibody modulator. Through these carefully engineered configurations the conjugate allows the release of an active PBD compound that preferably does not retain any part of the linker. That is, there is no stub or linker residue present that could adversely impact the reactivity of the PBD payload. Thus the disclosed DLL3 conjugates release the following dimeric PBD compounds upon cleavage of the linker.

A conjugate of ADC 1 releases the compound PBD 1:
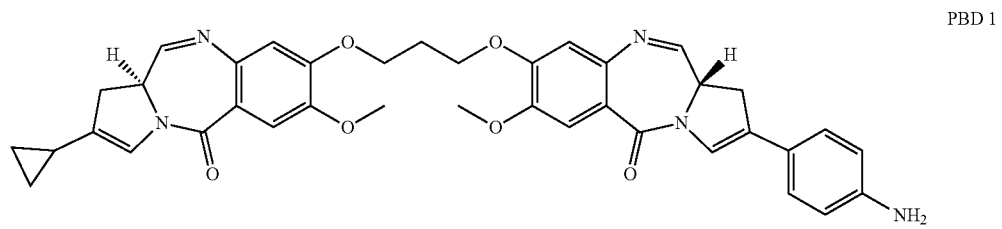 [SMILES: COc1cc2c(cc1OCCCOc1cc3c(cc1OC)C(=O)N1C=C(C4CC4)C[C@H]1C=N3)N=C[C@@H]1CC(c3ccc(N)cc3)=CN1C2=O]
PBD 1
A conjugate of ADC 2 releases the compound PBD 2:
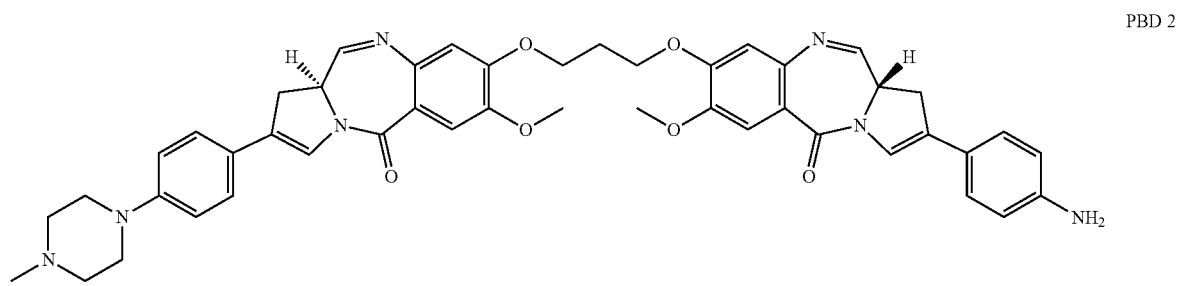 [SMILES: COc1cc2c(cc1OCCCOc1cc3c(cc1OC)C(=O)N1C=C(c4ccc(N5CCN(C)CC5)cc4)C[C@H]1C=N3)N=C[C@@H]1CC(c3ccc(N)cc3)=CN1C2=O]
PBD 2
A conjugate of ADC 3 releases the compound PBD 3:
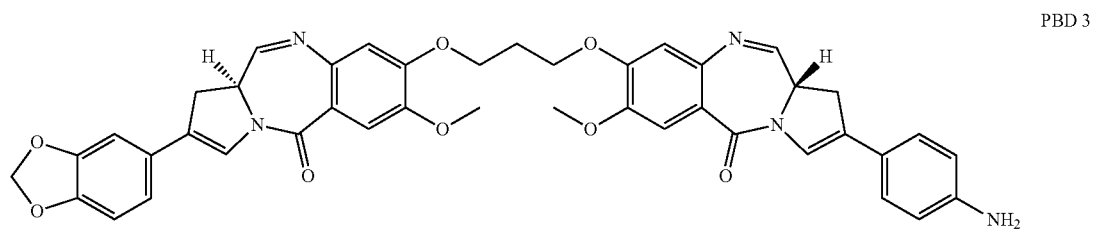 [SMILES: COc1cc2c(cc1OCCCOc1cc3c(cc1OC)C(=O)N1C=C(c4ccc5c(c4)OCO5)C[C@H]1C=N3)N=C[C@@H]1CC(c3ccc(N)cc3)=CN1C2=O]
PBD 3
A conjugate of ADC 4 releases the compound PBD 4:
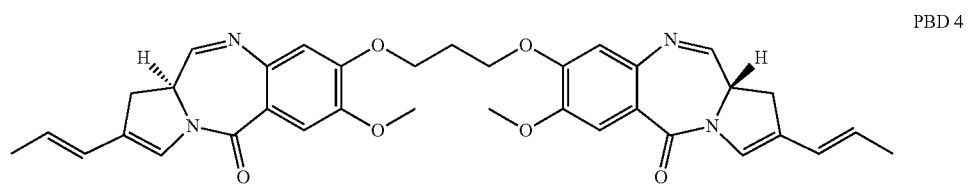 [SMILES: C/C=C/C1=CN2C(=O)c3cc(OC)c(OCCCOc4cc5c(cc4OC)C(=O)N4C=C(/C=C/C)C[C@H]4C=N5)cc3N=C[C@@H]2C1]
PBD 4
A conjugate of ADC 5 releases the compound PBD 5:
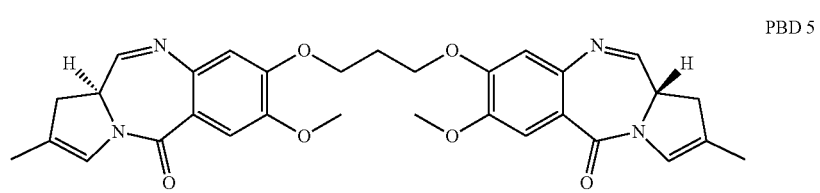
PBD 5

Accordingly, delivery of the toxic compounds of PBD 1, PBD 2, PBD 3, PBD 4 or PBD 5 is achieved at the desired activation site (i.e., within a tumorigenic cell) by ADCs 1-5 through the action of an enzyme, such as cathepsin, on the linking group, and in particular on the incorporated valine-alanine dipeptide moiety. As discussed in more detail below, localized delivery of the disclosed PBD cytotoxins may provide for effective elimination of several types of tumorigenic cells with substantially less toxicity than associated with non-targeted standard of care chemotherapies.

In this regard one aspect of the invention comprises the delivery of a compound selected from the group consisting of PBD 1, PBD 2, PBD 3, PBD 4 and PBD 5 comprising the step of administrating a DLL3 conjugate.

II. DLL3 Physiology

The Notch signaling pathway, first identified in *C. elegans* and *Drosophila* and subsequently shown to be evolutionarily conserved from invertebrates to vertebrates, participates in a series of fundamental biological processes including normal embryonic development, adult tissue homeostasis, and stem cell maintenance (D'Souza et al., 2010; Liu et al., 2010). Notch signaling is critical for a variety of cell types during specification, patterning and morphogenesis. Frequently, this occurs through the mechanism of lateral inhibition, in which cells expressing Notch ligand(s) adopt a default cell fate, yet suppress this fate in adjacent cells via stimulation of Notch signaling (Sternberg, 1988, Cabrera 1990). This binary cell fate choice mediated by Notch signaling is found to play a role in numerous tissues, including the developing nervous system (de la Pompa et al., 1997), the hematopoietic and immune systems (Bigas and Espinosoa, 2012; Hoyne et al, 2011; Nagase et al., 2011), the gut (Fre et al., 2005; Fre et al., 2009), the endocrine pancreas (Apelqvist et al., 1999; Jensen et al., 2000), the pituitary (Raetzman et al., 2004), and the diffuse neuroendocrine system (Ito et al., 2000; Schonhoff et al, 2004). A generalized mechanism for implementing this binary switch appears conserved despite the wide range of developmental systems in which Notch plays a role; e.g., in cells where the default cell fate choice is determined by transcriptional regulators known as basic helix-loop-helix (bHLH) proteins, Notch signaling leads to activation of a class of Notch responsive genes, which in turn suppress the activity of the bHLH proteins (Ball, 2004). These binary decisions take place in the wider context of developmental and signaling cues that permit Notch signaling to effect proliferation or inhibit it, and to trigger self-renewal or inhibit it.

In *Drosophila*, Notch signaling is mediated primarily by one Notch receptor gene and two ligand genes, known as Serrate and Delta (Wharton et al, 1985; Rebay et al., 1991). In humans, there are four known Notch receptors and five DSL (Delta-Serrate LAG2) ligands—two homologs of Serrate, known as Jagged1 and Jagged 2, and three homologs of Delta, termed delta-like ligands or DLL1, DLL3 and DLL4. In general, Notch receptors on the surface of the signal-receiving cell are activated by interactions with ligands expressed on the surface of an opposing, signal-sending cell (termed a trans-interaction). These trans-interactions lead to a sequence of protease mediated cleavages of the Notch receptor. In consequence, the Notch receptor intracellular domain is free to translocate from the membrane to the nucleus, where it partners with the CSL family of transcription factors (RBPJ in humans) and converts them from transcriptional repressors into activators of Notch responsive genes.

Of the human Notch ligands, DLL3 is different in that it seems incapable of activating the Notch receptor via trans-interactions (Ladi et al., 2005). Notch ligands may also interact with Notch receptors in cis (on the same cell) leading to inhibition of the Notch signal, although the exact mechanisms of cis-inhibition remain unclear and may vary depending upon the ligand (for instance, see Klein et al., 1997; Ladi et al., 2005; Glittenberg et al., 2006). Two hypothesized modes of inhibition include modulating Notch signaling at the cell surface by preventing trans-interactions, or by reducing the amount of Notch receptor on the surface of the cell by perturbing the processing of the receptor or by physically causing retention of the receptor in the endoplasmic reticulum or Golgi (Sakamoto et al., 2002; Dunwoodie, 2009). It is clear, however, that stochastic differences in expression of Notch receptors and ligands on neighboring cells can be amplified through both transcriptional and non-transcriptional processes, and subtle balances of cis- and trans-interactions can result in a fine tuning of the Notch mediated delineation of divergent cell fates in neighboring tissues (Sprinzak et al., 2010).

DLL3 (also known as Delta-like 3 or SCDO1) is a member of the Delta-like family of Notch DSL ligands. Representative DLL3 protein orthologs include, but are not limited to, human (Accession Nos. NP_058637 and NP_982353), chimpanzee (Accession No. XP_003316395), mouse (Accession No. NP_031892), and rat (Accession No. NP_446118). In humans, the DLL3 gene consists of 8 exons spanning 9.5 kBp located on chromosome 19q13. Alternate splicing within the last exon gives rise to two processed transcripts, one of 2389 bases (Accession No. NM_016941) and one of 2052 bases (Accession No. NM_203486). The former transcript encodes a 618 amino acid protein (Accession No. NP_058637; FIG. 1, SEQ ID NO: 1), whereas the latter encodes a 587 amino acid protein (Accession No. NP_982353; FIG. 1, SEQ ID NO: 2). These two protein isoforms of DLL3 share overall 100% identity across their extracellular domains and their transmembrane domains, differing only in that the longer isoform contains an extended cytoplasmic tail containing 32 additional residues at the carboxy terminus of the protein (FIG. 1). The biological relevance of the isoforms is unclear, although both isoforms can be detected in tumor cells.

In general, DSL ligands are composed of a series of structural domains: a unique N-terminal domain, followed by a conserved DSL domain, multiple tandem epidermal growth factor (EGF)-like repeats, a transmembrane domain, and a cytoplasmic domain not highly conserved across ligands but one which contains multiple lysine residues that are potential sites for ubiquitination by unique E3 ubiquitin ligases. The DSL domain is a degenerate EGF-domain that is necessary but not sufficient for interactions with Notch receptors (Shimizu et al., 1999). Additionally, the first two EGF-like repeats of most DSL ligands contain a smaller protein sequence motif known as a DOS domain that co-operatively interacts with the DSL domain when activating Notch signaling.

FIG. 2 provides a schematic diagram of the extracellular region of the DLL3 protein, illustrating the general juxta-position of the six EGF-like domains, the single DSL domain and the N-terminal domain. Generally, the EGF domains are recognized as occurring at about amino acid residues 216-249 (domain 1), 274-310 (domain 2), 312-351 (domain 3), 353-389 (domain 4), 391-427 (domain 5) and 429-465 (domain 6), with the DSL domain at about amino acid residues 176-215 and the N-terminal domain at about amino acid residues 27-175 of hDLL3 (SEQ ID NOS: 1 and 2). As discussed in more detail herein and shown in the Examples below, each of the EGF-like domains, the DSL domain and the N-terminal domain comprise part of the DLL3 protein as defined by a distinct amino acid sequence. Note that, for the purposes of the instant disclosure the respective EGF-like domains may be termed EGF1 to EGF6 with EGF1 being closest to the N-terminal portion of the protein. In regard to the structural composition of the protein one significant aspect of the instant invention is that the disclosed DLL3 modulators may be generated, fabricated, engineered or selected so as to react with a selected domain, motif or epitope. In certain cases such site specific modulators may provide enhanced reactivity and/or efficacy depending on their primary mode of action.

Note that, as used herein the terms "mature protein" or "mature polypeptide" as used herein refers to the form(s) of the protein produced by expression in a mammalian cell. It is generally hypothesized that once export of a growing protein chain across the rough endoplasmic reticulum has been initiated, proteins secreted by mammalian cells have a signal peptide (SP) sequence which is cleaved from the complete polypeptide to produce a "mature" form of the protein. In both isoforms of DLL3 the mature protein comprises a signal peptide of 26 amino acids that may be clipped prior to cell surface expression. Thus, in mature proteins the N-terminal domain will extend from position 27 in the protein until the beginning of the DSL domain. Of course, if the protein is not processed in this manner the N-terminal domain would be held to extend to position one of SEQ ID NOS: 1 & 2.

Of the various Delta-like ligands, DLL3 is the most divergent from the others in the family, since it contains a degenerate DSL domain, no DOS motifs, and an intracellular domain which lacks lysine residues. The degenerate DSL and lack of DOS motifs are consistent with the inability of DLL3 to trigger Notch signaling in trans (between cells), suggesting that DLL3, unlike DLL1 or DLL4, acts only as an inhibitor of Notch signaling (Ladi et al., 2005). Studies have shown that DLL3 may be resident primarily in the cis-Golgi (Geffers et al., 2007), which would be consistent with a hypothesized ability to retain Notch receptor intracellularly, or to interfere with processing of Notch receptors, preventing export to the cell surface and instead retargeting it to the lysosome (Chapman et al., 2011). Some DLL3 protein may appear at the cell surface, however, when the protein is artificially overexpressed in model systems (Ladi et al., 2005), but it is not obvious that this would be the case in normal biological contexts nor in tumors in which the DLL3 mRNA transcript is elevated; somewhat surprisingly, the protein levels detected in tumor types disclosed herein indicate significant DLL3 protein is escaping to the cell surface of various tumors.

Further, as discussed above Notch signaling plays a role in the development and maintenance of neuroendocrine cells and tumors exhibiting neuroendocrine features. In this regard Notch signaling is involved in a wide range of cell fate decisions in normal endocrine organs and in the diffuse neuroendocrine system. For instance, in the pancreas, Notch signaling is required to suppress the development of a default endocrine phenotype mediated by the bHLH transcription factor NGN3 (Habener et al, 2005). Similar Notch mediated suppression of endocrine cell fates occurs in enteroendocrine cells (Schonhoff et al., 2004), thyroid parafollicular cells (Cook et al., 2010), in specifying the relative ratios of neuroendocrine cell types in the pituitary (Dutta et al., 2011), and is likely involved in decisions of cells within the lungs to adopt a neuroendocrine or non-neuroendocrine pheneotype (Chen et al., 1997; Ito et al., 2000; Sriuranpong et al., 2002). Hence it is clear that in many tissues, suppression of Notch signaling is linked to neuroendocrine phenotypes.

Inappropriate reactivation of developmental signaling pathways or disregulation of normal signaling pathways are commonly observed in tumors, and in the case of Notch signaling, have been associated with numerous tumor types (Koch and Radtke, 2010; Harris et al., 2012). The Notch pathway has been studied as an oncogene in lymphomas, colorectal, pancreatic, and some types of non-small cell lung cancer (see Zarenczan and Chen, 2010 and references therein). In contrast, Notch is reported to act as a tumor suppressor in tumors with neuroendocrine features (see Zarenczan and Chen, 2010 supra). Tumors with neuroendocrine features arise infrequently in a wide range of primary sites, and while their exhaustive classification remains problematic (Yao et al., 2008; Klimstra et al., 2010; Klöppel, 2011), they may be classified into four major types: low grade benign carcinoids, low-grade well-differentiated neuroendocrine tumors with malignant behavior, tumors with mixed neuroendocrine and epithelial features, and high-grade poorly differentiated neuroendocrine carcinomas. Of these classifications, the poorly differentiated neuroendocrine carcinomas, which include small cell lung cancer (SCLC) and subsets of non-small cell lung cancer (NSCLC), are cancer types with dismal prognoses. It has been postulated that SCLC is bronchogenic in origin, arising in part from pulmonary neuroendocrine cells (Galluzzo and Bocchetta, 2011). Whatever the specific cellular source of origin for each of these tumors possessing a neuroendocrine phenotype, it may be expected that suppression of Notch signaling, either by direct lesions in the Notch pathway genes themselves, or by activation of other genes that suppress Notch signaling, may lead to the acquisition of the neuroendocrine phenotype of these tumors. By extension, the genes that lead to the perturbation of the Notch pathway may afford therapeutic targets for the treatment of tumors with neuroendocrine phenotypes, particularly for indications that currently have poor clinical outcomes.

ASCL1 is one such gene that appears to interact with Notch signaling pathway via DLL3. It is clear that many neuroendocrine tumors show a poorly differentiated (i.e. partially complete) endocrine phenotype; for instance, marked elevation or expression of various endocrine proteins and polypeptides (e.g. chromogranin A, CHGA; calcitonin, CALCA; propiomelanocorin, POMC; somatostatin, SST), proteins associated with secretory vesicles (e.g., synaptophysin, SYP), and genes involved in the biochemical pathways responsible for the synthesis of bioactive amines (e.g., dopa decarboxylase, DDC). Perhaps not surprisingly, these tumors frequently over-express ASCL1 (also known as mASH1 in mice, or hASH1 in humans), a transcription factor known to play a role in orchestrating gene cascades leading to neural and neuroendocrine phenotypes. Although the specific molecular details of the cascade remain ill-defined, it is increasingly clear that for certain cell types, particularly thyroid parafollicular cells (Kameda et al., 2007), chromaffin cells of the adrenal medulla (Huber et al., 2002) and cells found in the diffuse neuroendocrine system of the lung (Chen et al., 1997; Ito et al., 2000; Sriuranpong et al., 2002), ASCL1 is part of a finely tuned developmental regulatory loop in which cell fate choices are mediated by the balance of ASCL1-mediated and Notch-mediated gene expression cascades. For instance, ASCL1 was found in to be expressed in normal mouse pulmonary neuroendocrine cells, while the Notch signaling effector HES1, was expressed in pulmonary non-neuroendocrine cells (Ito et al., 2000). That these two cascades are in a fine balance with potential cross-regulation is increasingly appreciated. The Notch effector HES1 has been shown to downregulate ASCL1 expression (Chen et al., 1997; Sriuranpong et al., 2002). These results clearly demonstrate that Notch signaling can suppress neuroendocrine differentiation. However, demonstration that ASCL1 binding to the DLL3 promoter activates DLL3 expression (Henke et al., 2009) and the observation that DLL3 attenuates Notch signaling (Ladi et al., 2005) closes the genetic circuit for cell fate choices between neuroendocrine and non-neuroendocrine phenotypes.

Given that Notch signaling appears to have evolved to amplify subtle differences between neighboring cells to permit sharply bounded tissue domains with divergent differentiation paths (e.g., "lateral inhibition," as described above), these data together suggest that a finely tuned developmental regulatory loop has become reactivated and disregulated in cancers with neuroendocrine phenotypes. While it is not obvious that DLL3 would provide a suitable cell surface target for the development of antibody therapeutics given its normal residence within interior membranous compartments of the cell (Geffers et al., 2007) and its presumed interactions with Notch therein, it is possible that the resultant elevation of DLL3 expression in neuroendocrine tumors may offer a unique therapeutic target for tumors with the neuroendocrine phenotype (e.g., NETs and pNETs). It is commonly observed that vast overexpression of proteins in laboratory systems may cause mislocalization of the overexpressed protein within the cell. Therefore it is a reasonable hypothesis, yet not obvious without experimental verification, that overexpression of DLL3 in tumors may lead to some cell surface expression of the protein, and thereby present a target for the disclosed ADCs of the present invention.

III. Cancer Stem Cells

As alluded to above it has surprisingly been discovered that aberrant DLL3 expression (genotypic and/or phenotypic) is associated with various tumorigenic cell subpopulations. In this respect the present invention provides DLL3 antibody drug conjugates that may be particularly useful for targeting such cells (e.g., cancer stem cells), thereby facilitating the treatment, management or prevention of neoplastic disorders. Thus, in preferred embodiments the disclosed DLL3 ADCs may be advantageously be used to reduce tumor initiating cell frequency in accordance with the present teachings and thereby facilitate the treatment or management of proliferative disorders.

For the purposes of the instant application the term "tumor initiating cell" (TIC) encompasses both "tumor perpetuating cells" (TPC; i.e., cancer stem cells or CSC) and highly proliferative "tumor progenitor cells" (termed TProg), which together generally comprise a unique subpopulation (i.e. 0.1-40%) of a bulk tumor or mass. For the purposes of the instant disclosure the terms "tumor perpetuating cells" and "cancer stem cells" or "neoplastic stem cells" are equivalent and may be used interchangeably herein. TPC differ from TProg in that TPC can completely recapitulate the composition of tumor cells existing within a tumor and have unlimited self-renewal capacity as demonstrated by serial transplantation (two or more passages through mice) of low numbers of isolated cells, whereas TProg will not display unlimited self-renewal capacity.

Those skilled in the art will appreciate that fluorescence-activated cell sorting (FACS) using appropriate cell surface markers is a reliable method to isolate highly enriched cancer stem cell subpopulations (e.g., >99.5% purity) due, at least in part, to its ability to discriminate between single cells and clumps of cells (i.e. doublets, etc.). Using such techniques it has been shown that when low cell numbers of highly purified TProg cells are transplanted into immunocompromised mice they can fuel tumor growth in a primary transplant. However, unlike purified TPC subpopulations the TProg generated tumors do not completely reflect the parental tumor in phenotypic cell heterogeneity and are demonstrably inefficient at reinitiating serial tumorigenesis in subsequent transplants. In contrast, cancer stem cell subpopulations completely reconstitute the cellular heterogeneity of parental tumors and can efficiently initiate tumors when serially isolated and transplanted. Thus, those skilled in the art will recognize that a definitive difference between TPC and TProg, though both may be tumor generating in primary transplants, is the unique ability of TPC to perpetually fuel heterogeneous tumor growth upon serial transplantation at low cell numbers. Other common approaches to characterize TPC involve morphology and examination of cell surface markers, transcriptional profile, and drug response although marker expression may change with culture conditions and with cell line passage in vitro.

Accordingly, for the purposes of the instant invention tumor perpetuating cells, like normal stem cells that support cellular hierarchies in normal tissue, are preferably defined by their ability to self-renew indefinitely while maintaining the capacity for multilineage differentiation. Tumor perpetuating cells are thus capable of generating both tumorigenic progeny (i.e., tumor initiating cells: TPC and TProg) and non-tumorigenic (NTG) progeny. As used herein a "non-tumorigenic cell" (NTG) refers to a tumor cell that arises from tumor initiating cells, but does not itself have the capacity to self-renew or generate the heterogeneous lineages of tumor cells that comprise a tumor. Experimentally, NTG cells are incapable of reproducibly forming tumors in mice, even when transplanted in excess cell numbers.

As indicated, TProg are also categorized as tumor initiating cells (or TIC) due to their limited ability to generate tumors in mice. TProg are progeny of TPC and are typically capable of a finite number of non-self-renewing cell divisions. Moreover, TProg cells may further be divided into early tumor progenitor cells (ETP) and late tumor progenitor cells (LTP), each of which may be distinguished by phenotype (e.g., cell surface markers) and different capacities to recapitulate tumor cell architecture. In spite of such technical differences, both ETP and LTP differ functionally from TPC in that they are generally less capable of serially reconstituting tumors when transplanted at low cell numbers and typically do not reflect the heterogeneity of the parental tumor. Notwithstanding the foregoing distinctions, it has also been shown that various TProg populations can, on rare occasion, gain self-renewal capabilities normally attributed to stem cells and themselves become TPC (or CSC). In any event both types of tumor-initiating cells are likely represented in the typical tumor mass of a single patient and are subject to treatment with the modulators as disclosed herein. That is, the disclosed compositions are generally effective in reducing the frequency or altering the chemosensitivity of such DLL3 positive tumor initiating cells regardless of the particular embodiment or mix represented in a tumor.

In the context of the instant invention, TPC are more tumorigenic, relatively more quiescent and often more chemoresistant than the TProg (both ETP and LTP), NTG cells and the tumor-infiltrating non-TPC derived cells (e.g., fibroblasts/stroma, endothelial & hematopoietic cells) that comprise the bulk of a tumor. Given that conventional therapies and regimens have, in large part, been designed to both debulk tumors and attack rapidly proliferating cells, TPC are likely to be more resistant to conventional therapies and regimens than the faster proliferating TProg and other bulk tumor cell populations. Further, TPC often express other characteristics that make them relatively chemoresistant to conventional therapies, such as increased expression of multi-drug resistance transporters, enhanced DNA repair mechanisms and anti-apoptotic proteins. These properties, each of which contribute to drug tolerance by TPC, constitute a key reason for the failure of standard oncology treatment regimens to ensure long-term benefit for most patients with advanced stage neoplasia; i.e. the failure to adequately target and eradicate those cells that fuel continued tumor growth and recurrence (i.e. TPC or CSC).

Unlike many prior art treatments, the novel antibody drug conjugates of the present invention preferably reduce the frequency of tumor initiating cells upon administration to a subject of the ADC. As noted above, the reduction in tumor initiating cell frequency may occur as a result of a) elimination, depletion, sensitization, silencing or inhibition of tumor initiating cells; b) controlling the growth, expansion or recurrence of tumor initiating cells; c) interrupting the initiation, propagation, maintenance, or proliferation of tumor initiating cells; or d) by otherwise hindering the survival, regeneration and/or metastasis of the tumorigenic cells. In some embodiments, the reduction in the frequency of tumor initiating cells occurs as a result of a change in one or more physiological pathways. The change in the pathway, whether by reduction or elimination of the tumor initiating cells or by modifying their potential (e.g., induced differentiation, niche disruption) or otherwise interfering with their ability to influence the tumor environment or other cells, in turn allows for the more effective treatment of DLL3 associated disorders by inhibiting tumorigenesis, tumor maintenance and/or metastasis and recurrence.

Among art-recognized methods that can be used to assess such a reduction in the frequency of tumor initiating cells is limiting dilution analysis either in vitro or in vivo, preferably followed by enumeration using Poisson distribution statistics or assessing the frequency of predefined definitive events such as the ability to generate tumors in vivo or not. While such limiting dilution analysis comprise preferred methods of calculating reduction of tumor initiating cell frequency other, less demanding methods, may also be used to effectively determine the desired values, albeit slightly less accurately, and are entirely compatible with the teachings herein. Thus, as will be appreciated by those skilled in the art, it is also possible to determine reduction of frequency values through well-known flow cytometric or immunohistochemical means. As to all the aforementioned methods see, for example, Dylla et al. 2008, PMID: 18560594 & Hoey et al. 2009, PMID: 19664991; each of which is incorporated herein by reference in its entirety and, in particular, for the disclosed methods.

With respect to limiting dilution analysis, in vitro enumeration of tumor initiating cell frequency may be accomplished by depositing either fractionated or unfractionated human tumor cells (e.g. from treated and untreated tumors, respectively) into in vitro growth conditions that foster colony formation. In this manner, colony forming cells might be enumerated by simple counting and characterization of colonies, or by analysis consisting of, for example, the deposition of human tumor cells into plates in serial dilutions and scoring each well as either positive or negative for colony formation at least 10 days after plating. In vivo limiting dilution experiments or analyses, which are generally more accurate in their ability to determine tumor initiating cell frequency encompass the transplantation of human tumor cells, from either untreated control or treated populations, for example, into immunocompromised mice in serial dilutions and subsequently scoring each mouse as either positive or negative for tumor formation at least 60 days after transplant. The derivation of cell frequency values by limiting dilution analysis in vitro or in vivo is preferably done by applying Poisson distribution statistics to the known frequency of positive and negative events, thereby providing a frequency for events fulfilling the definition of a positive event; in this case, colony or tumor formation, respectively.

As to other methods compatible with the instant invention that may be used to calculate tumor initiating cell frequency, the most common comprise quantifiable flow cytometric techniques and immunohistochemical staining procedures. Though not as precise as the limiting dilution analysis techniques described immediately above, these procedures are much less labor intensive and provide reasonable values in a relatively short time frame. Thus, it will be appreciated that a skilled artisan may use flow cytometric cell surface marker profile determination employing one or more antibodies or reagents that bind art-recognized cell surface proteins known to enrich for tumor initiating cells (e.g., potentially compatible markers as are set forth in PCT application 2012/031280 which is incorporated herein in its entirety) and thereby measure TIC levels from various samples. In still another compatible method one skilled in the art might enumerate TIC frequency in situ (e.g., in a tissue section) by immunohistochemistry using one or more antibodies or reagents that are able to bind cell surface proteins thought to demarcate these cells.

It will be recognized that numerous markers (or their absence) have been associated with various populations of cancer stem cells and used to isolate or characterize tumor cell subpopulations. In this respect exemplary cancer stem cell markers comprise OCT4, Nanog, STAT3, EPCAM, CD24, CD34, NB84, TrkA, GD2, CD133, CD20, CD56, CD29, B7H3, CD46, transferrin receptor, JAM3, carboxypeptidase M, ADAM9, oncostatin M, Lgr5, Lgr6, CD324, CD325, nestin, Sox1, Bmi-1, eed, easyh1, easyh2, mf2, yy1, smarcA3, smarckA5, smarcD3, smarcE1, mllt3, FZD1, FZD2, FZD3, FZD4, FZD6, FZD7, FZD8, FZD9, FZD10, WNT2, WNT2B, WNT3, WNT5A, WNT10B, WNT16, AXIN1, BCL9, MYC, (TCF4) SLC7A8, IL1RAP, TEM8, TMPRSS4, MUC16, GPRC5B, SLC6A14, SLC4A11, PPAP2C, CAV1, CAV2, PTPN3, EPHA1, EPHA2, SLC1A1, CX3CL1, ADORA2A, MPZL1, FLJ10052, C4.4A, EDG3, RARRES1, TMEPAI, PTS, CEACAM6, NID2, STEAP, ABCA3, CRIM1, IL1R1, OPN3, DAF, MUC1, MCP, CPD, NMA, ADAM9, GJA1, SLC19A2, ABCA1, PCDH7, ADCY9, SLC39A1, NPC1, ENPP1, N33, GPNMB, LY6E, CELSR1, LRP3, C20orf52, TMEPAI, FLVCR, PCDHA10, GPR54, TGFBR3, SEMA4B, PCDHB2, ABCG2, CD166, AFP, BMP-4, β-catenin, CD2, CD3, CD9, CD14, CD31, CD38, CD44, CD45, CD74, CD90, CXCR4, decorin, EGFR, CD105, CD64, CD16, CD16a, CD16b, GLI1, GLI2, CD49b, and CD49f. See, for example, Schulenburg et al., 2010, PMID: 20185329, U.S. Pat. No. 7,632,678 and U.S.P.Ns. 2007/0292414, 2008/0175870, 2010/0275280, 2010/0162416 and 2011/0020221 each of which is incorporated herein by reference. It will further be appreciated that each of the aforementioned markers may also be used as a secondary target antigen in the context of the bispecific or multispecific antibodies of the instant invention.

Similarly, non-limiting examples of cell surface phenotypes associated with cancer stem cells of certain tumor types include $CD44^{hi}CD24^{low}$, $ALDH^+$, $CD133^+$, $CD123^+$, $CD34^+CD38^-$, $CD44^+CD24^-$, $CD46^{hi}CD324^+CD66c^-$, $CD133^+CD34^+CD10^-CD19^-$, $CD138^-CD34^-CD19^+$, $CD133^+RC2^+$, $CD44^+\alpha_2\beta_1^{hi}CD133^+$, $CD44^+CD24^+ESA^+$, $CD271^+$, $ABCB5^+$ as well as other cancer stem cell surface phenotypes that are known in the art. See, for example, Schulenburg et al., 2010, supra, Visvader et al., 2008, PMID: 18784658 and U.S.P.N. 2008/0138313, each of which is incorporated herein in its entirety by reference. Those skilled in the art will appreciate that marker phenotypes such as those exemplified immediately above may be used in conjunction with standard flow cytometric analysis and cell sorting techniques to characterize, isolate, purify or enrich TIC and/or TPC cells or cell populations for further analysis. Of interest with regard to the instant invention CD46, CD324 and, optionally, CD66c are either highly or heterogeneously expressed on the surface of many human colorectal ("CR"), breast ("BR"), non-small cell lung (NSCLC), small cell lung (SCLC), pancreatic ("PA"), melanoma ("Mel"), ovarian ("OV"), and head and neck cancer ("HN") tumor cells, regardless of whether the tumor specimens being analyzed were primary patient tumor specimens or patient-derived Non-Traditional Xenograft (NTX) tumors.

Using any of the above-referenced methods and selected markers as known in the art it is then possible to quantify the reduction in frequency of TIC (or the TPC therein) provided by the disclosed DLL3 modulators (including those conjugated to cytotoxic agents) in accordance with the teachings herein. In some instances, the compounds of the instant invention may reduce the frequency of TIC or TPC (by a variety of mechanisms noted above, including elimination, induced differentiation, niche disruption, silencing, etc.) by 10%, 15%, 20%, 25%, 30% or even by 35%. In other embodiments, the reduction in frequency of TIC or TPC may be on the order of 40%, 45%, 50%, 55%, 60% or 65%. In certain embodiments, the disclosed compounds my reduce the frequency of TIC or TPC by 70%, 75%, 80%, 85%, 90% or even 95%. Of course it will be appreciated that any reduction of the frequency of the TIC or TPC likely results in a corresponding reduction in the tumorigenicity, persistence, recurrence and aggressiveness of the neoplasia.

IV. Cell Binding Agents

1. Antibody Structure

As alluded to above, particularly preferred embodiments of the instant invention comprise the disclosed DLL3 conjugates with a cell binding agent in the form of an antibody, or immunoreactive fragment thereof, that preferentially associates with one or more domains of an isoform of DLL3 protein and, optionally, other DLL family members. In this regard antibodies, and variants and derivatives thereof, including accepted nomenclature and numbering systems, have been extensively described, for example, in Abbas et al. (2010), *Cellular and Molecular Immunology* ($6^{th}$ Ed.), W.B. Saunders Company; or Murphey et al. (2011), *Janeway's Immunobiology* ($8^{th}$ Ed.), Garland Science.

An "antibody" or "intact antibody" typically refers to a Y-shaped tetrameric protein comprising two heavy (H) and two light (L) polypeptide chains held together by covalent disulfide bonds and non-covalent interactions. Human light chains comprise a variable domain ($V_L$) and a constant domain ($C_L$) wherein the constant domain may be readily classified as kappa or lambda based on amino acid sequence and gene loci. Each heavy chain comprises one variable domain ($V_H$) and a constant region, which in the case of IgG, IgA, and IgD, comprises three domains termed $C_H1$, $C_H2$, and $C_H3$ (IgM and IgE have a fourth domain, $C_H4$). In IgG, IgA, and IgD classes the $C_H1$ and $C_H2$ domains are separated by a flexible hinge region, which is a proline and cysteine rich segment of variable length (generally from about 10 to about 60 amino acids in IgG). The variable domains in both the light and heavy chains are joined to the constant domains by a "J" region of about 12 or more amino acids and the heavy chain also has a "D" region of about 10 additional amino acids. Each class of antibody further comprises inter-chain and intra-chain disulfide bonds formed by paired cysteine residues.

As used herein the term "antibody" may be construed broadly and includes polyclonal antibodies, multiclonal antibodies, monoclonal antibodies, chimeric antibodies, humanized and primatized antibodies, CDR grafted antibodies, human antibodies, recombinantly produced antibodies, intrabodies, multispecific antibodies, bispecific antibodies, monovalent antibodies, multivalent antibodies, anti-idiotypic antibodies, synthetic antibodies, including muteins and variants thereof, immunospecific antibody fragments such as Fd, Fab, F(ab')$_2$, F(ab') fragments, single-chain fragments (e.g. ScFv and ScFvFc); and derivatives thereof including Fc fusions and other modifications, and any other immunoreactive molecule so long as it exhibits preferential association or binding with a DLL3 determinant. Moreover, unless dictated otherwise by contextual constraints the term further comprises all classes of antibodies (i.e. IgA, IgD, IgE, IgG, and IgM) and all isotypes (i.e., IgG1, IgG2, IgG3, IgG4, IgA1, and IgA2). Heavy-chain constant domains that correspond to the different classes of antibodies are typically denoted by the corresponding lower case Greek letter α, δ, ε, γ, and μ, respectively. Light chains of the antibodies from any vertebrate species can be assigned to one of two clearly distinct types, called kappa (κ) and lambda (λ), based on the amino acid sequences of their constant domains.

In selected embodiments and as shown in the appended Examples, the $C_L$ domain may comprise a kappa $C_L$ domain. In other embodiments the source antibody may comprise a lambda $C_L$ domain. As the sequences of all human IgG $C_L$ domains are well known, one skilled in the art may easily analyze both lambda and kappa sequences in accordance with the instant disclosure and employ the same to provide compatible antibody constructs. Similarly, for the purposes of explanation and demonstration the following discussion and appended Examples will primarily feature the IgG1 (murine or human) type antibodies. As with the light chain constant region, heavy chain constant domain sequences from different isotypes (IgM, IgD, IgE, IgA) and subclasses (IgG1, IgG2, IgG3, IgG4, IgA1, IgA2) are well known and characterized. Accordingly, one skilled in the art may readily exploit anti-DLL3 antibodies comprising any isotype or subclass and conjugate each with the disclosed PBDs as taught herein to provide the antibody drug conjugates of the present invention.

The variable domains of antibodies show considerable variation in amino acid composition from one antibody to another and are primarily responsible for antigen recognition and binding. Variable regions of each light/heavy chain pair form the antibody binding site such that an intact IgG antibody has two binding sites (i.e. it is bivalent). $V_H$ and $V_L$ domains comprise three regions of extreme variability, which are termed hypervariable regions, or more commonly, complementarity-determining regions (CDRs), framed and separated by four less variable regions known as framework regions (FRs). The non-covalent association between the $V_H$ and the $V_L$ region forms the Fv fragment (for "fragment variable") which contains one of the two antigen-binding sites of the antibody. ScFv fragments (for single chain fragment variable), which can be obtained by genetic engineering, associates in a single polypeptide chain, the $V_H$ and the $V_L$ region of an antibody, separated by a peptide linker.

As used herein, the assignment of amino acids to each domain, framework region and CDR may be in accordance with one of the numbering schemes provided by Kabat et al. (1991) *Sequences of Proteins of Immunological Interest* (5$^{th}$ Ed.), US Dept. of Health and Human Services, PHS, NIH, NIH Publication no. 91-3242; Chothia et al., 1987, PMID: 3681981; Chothia et al., 1989, PMID: 2687698; MacCallum et al., 1996, PMID: 8876650; or Dubel, Ed. (2007) *Handbook of Therapeutic Antibodies*, 3$^{rd}$ Ed., Wily-VCH Verlag GmbH and Co. unless otherwise noted. Amino acid residues which comprise CDRs as defined by Kabat, Chothia and MacCallum as obtained from the Abysis website database (infra)) are set out below

TABLE 1

|  | Kabat | Chothia | MacCallum |
|---|---|---|---|
| $V_H$ CDR1 | 31-35 | 26-32 | 30-35 |
| $V_H$ CDR2 | 50-65 | 52-56 | 47-58 |
| $V_H$ CDR3 | 95-102 | 95-102 | 93-101 |
| $V_L$ CDR1 | 24-34 | 24-34 | 30-36 |
| $V_L$ CDR2 | 50-56 | 50-56 | 46-55 |
| $V_L$ CDR3 | 89-97 | 89-97 | 89-96 |

Variable regions and CDRs in an antibody sequence can be identified according to general rules that have been developed in the art (as set out above, such as, for example, the Kabat numbering system) or by aligning the sequences against a database of known variable regions. Methods for identifying these regions are described in Kontermann and Dubel, eds., Antibody Engineering, Springer, New York, N.Y., 2001 and Dinarello et al., Current Protocols in Immunology, John Wiley and Sons Inc., Hoboken, N. J., 2000. Exemplary databases of antibody sequences are described in, and can be accessed through, the "Abysis" website at www.bioinf.org.uk/abs (maintained by A. C. Martin in the Department of Biochemistry & Molecular Biology University College London, London, England) and the VBASE2 website at www.vbase2.org, as described in Retter et al., Nucl. Acids Res., 33 (Database issue): D671-D674 (2005). Preferably sequences are analyzed using the Abysis database, which integrates sequence data from Kabat, IMGT and the Protein Data Bank (PDB) with structural data from the PDB. See Dr. Andrew C. R. Martin's book chapter *Protein Sequence and Structure Analysis of Antibody Variable Domains*. In: *Antibody Engineering Lab Manual* (Ed.: Duebel, S. and Kontermann, R., Springer-Verlag, Heidelberg, ISBN-13: 978-3540413547, also available on the website bioinforg.uk/abs). The Abysis database website further includes general rules that have been developed for identifying CDRs which can be used in accordance with the teachings herein. Unless otherwise indicated, all CDRs set forth herein are derived according to the Abysis database website as per Kabat.

For heavy chain constant region amino acid positions discussed in the invention, numbering is according to the Eu index first described in Edelman et al., 1969, Proc, Natl. Acad. Sci. USA 63(1): 78-85 describing the amino acid sequence of myeloma protein Eu, which reportedly was the first human IgG1 sequenced. The Eu index of Edelman is also set forth in Kabat et al., 1991 (supra.). Thus, the terms "EU index as set forth in Kabat" or "EU index of Kabat" in the context of the heavy chain refers to the residue numbering system based on the human IgG1 Eu antibody of Edelman et al. as set forth in Kabat et al., 1991 (supra.). The numbering system used for the light chain constant region amino acid sequence is similarly set forth in Kabat et al., 1991. Exemplary kappa $C_L$ and IgG1 heavy chain constant region amino acid sequences compatible with the instant invention are set forth as SEQ ID NOS: 5 and 6 in the appended sequence listing. Those of skill in the art will appreciate that the disclosed constant region sequences may be joined with the disclosed heavy and light chain variable regions using standard molecular biology techniques to provide full-length antibodies that may be incorporated in the DLL3 conjugates of the instant invention.

The antibodies or immunoglobulins of the invention may comprise, or be derived from, any antibody that specifically recognizes or associates with any DLL3 determinant. As used herein "determinant" or "target" means any detectable trait, property, marker or factor that is identifiably associated with, or specifically found in or on a particular cell, cell population or tissue. Determinants or targets may be morphological, functional or biochemical in nature and are preferably phenotypic. In certain preferred embodiments a determinant is a protein that is differentially expressed (over- or under-expressed) by specific cell types or by cells under certain conditions (e.g., during specific points of the cell cycle or cells in a particular niche). For the purposes of the instant invention a determinant preferably is differentially expressed on aberrant cancer cells and may comprise a DLL3 protein, or any of its splice variants, isoforms or family members, or specific domains, regions or epitopes thereof. An "antigen", "immunogenic determinant", "antigenic determinant" or "immunogen" means any protein (including DLL3) or any fragment, region, domain or epitope thereof that can stimulate an immune response when introduced into an immunocompetent animal and is recognized by antibodies produced from the immune response of the animal. The presence or absence of the determinants contemplated herein may be used to identify a cell, cell subpopulation or tissue (e.g., tumors, tumorigenic cells or CSCs).

As set forth below in the Examples, selected embodiments of the invention comprise murine antibodies that immunospecifically bind to DLL3, which can be considered "source" antibodies. In other embodiments, antibodies contemplated by the invention may be derived from such "source" antibodies through optional modification of the constant region or the epitope-binding amino acid sequences of the source antibody. In one embodiment an antibody is "derived" from a source antibody if selected amino acids in the source antibody are altered through deletion, mutation, substitution, integration or combination. In another embodiment, a "derived" antibody is one in which fragments of the source antibody (e.g., one or more CDRs or the entire variable region) are combined with or incorporated into an acceptor antibody sequence to provide the derivative antibody (e.g. chimeric, CDR grafted or humanized antibodies). These "derived" (e.g. humanized or CDR-grafted) antibodies can be generated using standard molecular biology techniques for various reasons such as, for example, to improve affinity for the determinant; to improve production and yield in cell culture; to reduce immunogenicity in vivo; to reduce toxicity; to facilitate conjugation of an active moiety; or to create a multispecific antibody. Such antibodies may also be derived from source antibodies through modification of the mature molecule (e.g., glycosylation patterns or pegylation) by chemical means or post-translational modification.

In the context of the instant invention it will be appreciated that any of the disclosed light and heavy chain CDRs derived from the murine variable region amino acid sequences set forth in FIG. 3A or FIG. 3B may be combined with acceptor antibodies or rearranged to provide optimized anti-human DLL3 (e.g. humanized or chimeric anti-hDLL3) antibodies in accordance with the instant teachings. That is, one or more of the CDRs derived or obtained from the contiguous light chain variable region amino acid sequences set forth in FIG. 3A or the contiguous heavy chain variable region amino acid sequences set forth in FIG. 3B (together SEQ ID NOS: 21-387, odd numbers) may be incorporated in a DLL3 modulator and, in particularly preferred embodiments, in a CDR grafted or humanized antibody that immunospecifically associates with one or more DLL3 isoforms. Examples of "derived" light and heavy chain variable region amino acid sequences of such humanized modulators are also set forth in FIGS. 3A and 3B (SEQ ID NOS: 389-407, odd numbers).

In FIGS. 3A and 3B the annotated CDRs and framework sequences are defined as per Kabat using a proprietary Abysis database. However, as discussed herein one skilled in the art could readily define, identify, derive and/or enumerate the CDRs as defined by Kabat et al., Chothia et al. or MacCallum et al. for each respective heavy and light chain sequence set forth in FIG. 3A or FIG. 3B. Accordingly, each of the subject CDRs and antibodies comprising CDRs defined by all such nomenclature are expressly included within the scope of the instant invention. More broadly, the terms "variable region CDR amino acid residue" or more simply "CDR" includes amino acids in a CDR as identified using any sequence or structure based method as set forth above. Within this context Kabat CDRs for the exemplary humanized antibodies in FIGS. 3A and 3B are provided in the appended sequence listing as SEQ ID NOS: 408-437.

In yet other embodiments, a compatible DLL3 antibody comprises heavy and light chain variable regions comprising amino acid sequences that are homologous to the amino acid sequences of the exemplary antibodies described herein (both humanized and murine), and wherein the antibodies retain the desired functional properties of the anti-DLL3 antibodies of the invention.

For example compatible DLL3 antibodies may comprise an antibody or immunoreactive fragment thereof having a light chain variable region and a heavy chain variable region wherein said light chain variable region comprises an amino acid sequence that is at least 60% homologous to an amino acid sequence selected from the group consisting of SEQ ID NO: 21, SEQ ID NO: 25, SEQ ID NO: 29, SEQ ID NO: 33, SEQ ID NO: 37, SEQ ID NO: 41, SEQ ID NO: 45, SEQ ID NO: 49, SEQ ID NO: 53, SEQ ID NO: 57, SEQ ID NO: 61, SEQ ID NO: 65, SEQ ID NO: 69, SEQ ID NO: 73, SEQ ID NO: 77, SEQ ID NO: 81, SEQ ID NO: 85, SEQ ID NO: 89, SEQ ID NO: 93, SEQ ID NO: 97, SEQ ID NO: 101, SEQ ID NO: 105, SEQ ID NO: 109, SEQ ID NO: 113, SEQ ID NO: 117, SEQ ID NO: 121, SEQ ID NO: 125, SEQ ID NO: 129, SEQ ID NO: 133, SEQ ID NO: 137, SEQ ID NO: 141, SEQ ID NO: 145, SEQ ID NO: 149, SEQ ID NO: 153, SEQ ID NO: 157, SEQ ID NO: 161, SEQ ID NO: 165, SEQ ID NO: 169, SEQ ID NO: 173, SEQ ID NO: 177, SEQ ID NO: 181, SEQ ID NO: 185, SEQ ID NO: 189, SEQ ID NO: 193, SEQ ID NO: 197, SEQ ID NO: 201, SEQ ID NO: 205, SEQ ID NO: 209, SEQ ID NO: 213, SEQ ID NO: 217, SEQ ID NO: 221, SEQ ID NO: 225, SEQ ID NO: 229, SEQ ID NO: 233, SEQ ID NO: 237, SEQ ID NO: 241, SEQ ID NO: 245, SEQ ID NO: 249, SEQ ID NO: 253, SEQ ID NO: 257, SEQ ID NO: 261, SEQ ID NO: 265, SEQ ID NO: 269, SEQ ID NO: 273, SEQ ID NO: 277, SEQ ID NO: 281, SEQ ID NO: 285, SEQ ID NO: 289, SEQ ID NO: 293, SEQ ID NO: 297, SEQ ID NO: 301, SEQ ID NO: 305, SEQ ID NO: 309, SEQ ID NO: 313, SEQ ID NO: 317, SEQ ID NO: 321, SEQ ID NO: 325, SEQ ID NO: 329, SEQ ID NO: 333, SEQ ID NO: 337, SEQ ID NO: 341, SEQ ID NO: 345, SEQ ID NO: 349, SEQ ID NO: 353, SEQ ID NO: 357, SEQ ID NO: 361, SEQ ID NO: 365, SEQ ID NO: 369, SEQ ID NO: 373, SEQ ID NO: 377, SEQ ID NO: 381 and SEQ ID NO: 385 and wherein said heavy chain variable region comprises an amino acid sequence that is at least 60% homologous to an amino acid sequence selected from the group consisting of SEQ ID NO: 23, SEQ ID NO: 27, SEQ ID NO: 31, SEQ ID NO: 35, SEQ ID NO: 39, SEQ ID NO: 43, SEQ ID NO: 47, SEQ ID NO: 51, SEQ ID NO: 55, SEQ ID NO: 59, SEQ ID NO: 63, SEQ ID NO: 67, SEQ ID NO: 71, SEQ ID NO: 75, SEQ ID NO: 79, SEQ ID NO: 83, SEQ ID NO: 87, SEQ ID NO: 91, SEQ ID NO: 95, SEQ ID NO: 99, SEQ ID NO: 103, SEQ ID NO: 107, SEQ ID NO: 111, SEQ ID NO: 115, SEQ ID NO: 119, SEQ ID NO: 123, SEQ ID NO: 127, SEQ ID NO: 131, SEQ ID NO: 135, SEQ ID NO: 139 SEQ ID NO: 143, SEQ ID NO: 147, SEQ ID NO: 151, SEQ ID NO: 155, SEQ ID NO: 159, SEQ ID NO: 163, SEQ ID NO: 167, SEQ ID NO: 171, SEQ ID NO: 175, SEQ ID NO: 179, SEQ ID NO: 183, SEQ ID NO: 187, SEQ ID NO: 191, SEQ ID NO: 195, SEQ ID NO: 199, SEQ ID NO: 203, SEQ ID NO: 207, SEQ ID NO: 211, SEQ ID NO: 215, SEQ ID NO: 219, SEQ ID NO: 223, SEQ ID NO: 227, SEQ ID NO: 231, SEQ ID NO: 235, SEQ ID NO: 239, SEQ ID NO: 243, SEQ ID NO: 247, SEQ ID NO: 251, SEQ ID NO: 255, SEQ ID NO: 259, SEQ ID NO: 263, SEQ ID NO: 267, SEQ ID NO: 271, SEQ ID NO: 275, SEQ ID NO: 279, SEQ ID NO: 283, SEQ ID NO: 287, SEQ ID NO: 291, SEQ ID NO: 295, SEQ ID NO: 299, SEQ ID NO: 303, SEQ ID NO: 307 SEQ ID NO: 311, SEQ ID NO: 315, SEQ ID NO: 319, SEQ ID NO: 323, SEQ ID NO: 327, SEQ ID NO: 331, SEQ ID NO: 335, SEQ ID NO: 339, SEQ ID NO: 343, SEQ ID NO: 347, SEQ ID NO: 351, SEQ ID NO: 355, SEQ ID NO: 359, SEQ ID NO: 363, SEQ ID NO: 367, SEQ ID NO: 371, SEQ ID NO: 375, SEQ ID NO: 379, SEQ ID NO: 383 and SEQ ID NO: 387.

In other embodiments, the $V_H$ and/or $V_L$ amino acid sequences may be 65%, 70%, 75%, 80%, 85%, 90% or 95% homologous to the sequences set forth above. An antibody having $V_H$ and $V_L$ regions having high (i.e., 80% or greater) homology to the $V_H$ and $V_L$ regions of the sequences set forth above, can be obtained or derived using standard molecular biology techniques. For example, as shown in TABLE 4 below a humanized antibody derived as set forth in Example 4 from a murine source antibody will comprise heavy and light chain variable regions that are roughly 75% to 85% homologous to those of the source antibody.

As used herein, the percent homology between two amino acid sequences is equivalent to the percent identity between the two sequences. The percent identity between the two sequences is a function of the number of identical positions shared by the sequences (i.e., % homology=# of identical positions/total # of positions×100), taking into account the number of gaps, and the length of each gap, which need to be introduced for optimal alignment of the two sequences. The comparison of sequences and determination of percent identity between two sequences can be accomplished using a mathematical algorithm, as described in the non-limiting examples below.

The percent identity between two amino acid sequences can be determined using the algorithm of E. Meyers and W. Miller (*Comput. Appl. Biosci.*, 4:11-17 (1988)) which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (*J. Mol. Biol.* 48:444-453 (1970)) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6.

Additionally or alternatively, the protein sequences of the present invention can further be used as a "query sequence" to perform a search against public databases to, for example, identify related sequences. Such searches can be performed using the XBLAST program (version 2.0) of Altschul, et al. (1990) *J. Mol. Biol.* 215:403-10. BLAST protein searches can be performed with the XBLAST program, score=50, wordlength=3 to obtain amino acid sequences homologous to the antibody molecules of the invention. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, the default parameters of the respective programs (e.g., XBLAST and NBLAST) can be used.

2. Antibody Generation a. Polyclonal Antibodies

The production of polyclonal antibodies in various host animals, including rabbits, mice, rats, etc. is well known in the art. In some embodiments, polyclonal anti-DLL3 antibody-containing serum is obtained by bleeding or sacrificing the animal. The serum may be used for research purposes in the form obtained from the animal or, in the alternative, the anti-DLL3 antibodies may be partially or fully purified to provide immunoglobulin fractions or homogeneous antibody preparations.

Briefly the selected animal is immunized with a DLL3 immunogen (e.g., soluble DLL3 or sDLL3) which may, for example, comprise selected isoforms, domains and/or peptides, or live cells or cell preparations expressing DLL3 or immunoreactive fragments thereof. Art known adjuvants that may be used to increase the immunological response, depending on the inoculated species include, but are not limited to, Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, and potentially useful human adjuvants such as BCG (bacille Calmette-Guerin) and *corynebacterium parvum*. Such adjuvants may protect the antigen from rapid dispersal by sequestering it in a local deposit, or they may contain substances that stimulate the host to secrete factors that are chemotactic for macrophages and other components of the immune system. Preferably the immunization schedule will involve two or more administrations of the selected immunogen spread out over a predetermined period of time.

The amino acid sequence of a DLL3 protein as shown in FIG. 1 can be analyzed to select specific regions of the DLL3 protein for generating antibodies. For example, hydrophobicity and hydrophilicity analyses of a DLL3 amino acid sequence are used to identify hydrophilic regions in the DLL3 structure. Regions of a DLL3 protein that show immunogenic structure, as well as other regions and domains, can readily be identified using various other methods known in the art, such as Chou-Fasman, Garnier-Robson, Kyte-Doolittle, Eisenberg, Karplus-Schultz or Jameson-Wolf analysis. Average Flexibility profiles can be generated using the method of Bhaskaran R., Ponnuswamy P. K., 1988, Int. J. Pept. Protein Res. 32:242-255. Beta-turn profiles can be generated using the method of Deleage, G., Roux B., 1987, Protein Engineering 1:289-294. Thus, each DLL3 region, domain or motif identified by any of these programs or methods is within the scope of the present invention and may be isolated or engineered to provide immunogens giving rise to modulators comprising desired properties. Preferred methods for the generation of DLL3 antibodies are further illustrated by way of the Examples provided herein. Methods for preparing a protein or polypeptide for use as an immunogen are well known in the art. Also well known in the art are methods for preparing immunogenic conjugates of a protein with a carrier, such as BSA, KLH or other carrier protein. In some circumstances, direct conjugation using, for example, carbodiimide reagents are used; in other instances linking reagents are effective. Administration of a DLL3 immunogen is often conducted by injection over a suitable time period and with use of a suitable adjuvant, as is understood in the art. During the immunization schedule, titers of antibodies can be taken as described in the Examples below to determine adequacy of antibody formation.

b. Monoclonal Antibodies

In addition, the invention contemplates use of monoclonal antibodies. As known in the art, the term "monoclonal antibody" (or mAb) refers to an antibody obtained from a population of substantially homogeneous antibodies, i.e., the individual antibodies comprising the population are identical except for possible mutations (e.g., naturally occurring mutations), that may be present in minor amounts. In certain embodiments, such a monoclonal antibody includes an antibody comprising a polypeptide sequence that binds or associates with an antigen wherein the antigen-binding polypeptide sequence was obtained by a process that includes the selection of a single target binding polypeptide sequence from a plurality of polypeptide sequences.

More generally, and as set forth in the Examples herein, monoclonal antibodies can be prepared using a wide variety of techniques known in the art including hybridoma techniques, recombinant techniques, phage display technologies, transgenic animals (e.g., a XenoMouse®) or some combination thereof. For example, monoclonal antibodies can be produced using hybridoma and art-recognized biochemical and genetic engineering techniques such as described in more detail in An, Zhigiang (ed.) *Therapeutic Monoclonal Antibodies: From Bench to Clinic*, John Wiley and Sons, 1$^{st}$ ed. 2009; Shire et. al. (eds.) *Current Trends in Monoclonal Antibody Development and Manufacturing*, Springer Science+Business Media LLC, 1$^{st}$ ed. 2010; Harlow et al., *Antibodies: A Laboratory Manual*, Cold Spring Harbor Laboratory Press, 2nd ed. 1988; Hammerling, et al., in: *Monoclonal Antibodies and T-Cell Hybridomas* 563-681 (Elsevier, N.Y., 1981) each of which is incorporated herein in its entirety by reference. It should be understood that a selected binding sequence can be further altered, for example, to improve affinity for the target, to humanize the target binding sequence, to improve its production in cell culture, to reduce its immunogenicity in vivo, to create a multispecific antibody, etc., and that an antibody comprising the altered target binding sequence is also an antibody of this invention.

c. Chimeric and Humanized Antibodies

In another embodiment, the antibodies of the invention may comprise chimeric antibodies derived from covalently joined protein segments from at least two different species or class of antibodies. The term "chimeric" antibodies is directed to constructs in which a portion of the heavy and/or light chain is identical or homologous to corresponding sequences in antibodies derived from a particular species or belonging to a particular antibody class or subclass, while the remainder of the chain(s) is identical or homologous to corresponding sequences in antibodies derived from another species or belonging to another antibody class or subclass, as well as fragments of such antibodies (U.S. Pat. No. 4,816,567; Morrison et al., 1984, PMID: 6436822).

In one embodiment, a chimeric antibody may comprise murine $V_H$ and $V_L$ amino acid sequences and constant regions derived from human sources, for example, humanized antibodies as described below. In some embodiments, the antibodies can be "CDR-grafted", where the antibody comprises one or more CDRs from a particular species or belonging to a particular antibody class or subclass, while the remainder of the antibody chain(s) is/are identical with or homologous to a corresponding sequence in antibodies derived from another species or belonging to another antibody class or subclass. For use in humans, selected rodent CDRs, e.g., mouse CDRs may be grafted into a human antibody, replacing one or more of the naturally occurring CDRs of the human antibody. These constructs generally have the advantages of providing full strength antibody functions, e.g., complement dependent cytotoxicity (CDC) and antibody-dependent cell-mediated cytotoxicity (ADCC) while reducing unwanted immune responses to the antibody by the subject.

Similar to the CDR-grafted antibody is a "humanized" antibody. As used herein, "humanized" forms of non-human (e.g., murine) antibodies are chimeric antibodies that comprise amino acids sequences derived from one or more non-human immunoglobulins. In one embodiment, a humanized antibody is a human immunoglobulin (recipient or acceptor antibody) in which residues from one or more CDRs of the recipient are replaced by residues from one or more CDRs of a non-human species (donor antibody) such as mouse, rat, rabbit, or non-human primate. In certain preferred embodiments, residues in one or more FRs in the variable domain of the human immunoglobulin are replaced by corresponding non-human residues from the donor antibody to help maintain the appropriate three-dimensional configuration of the grafted CDR(s) and thereby improve affinity. This can be referred to as the introduction of "back mutations". Furthermore, humanized antibodies may comprise residues that are not found in the recipient antibody or in the donor antibody to, for example, further refine antibody performance.

Various sources can be used to determine which human sequences to use in the humanized antibodies. Such sources include human germline sequences that are disclosed, for example, in Tomlinson, I. A. et al. (1992) *J. Mol. Biol.* 227:776-798; Cook, G. P. et al. (1995) *Immunol. Today* 16: 237-242; Chothia, D. et al. (1992) *J. Mol. Biol.* 227:799-817; and Tomlinson et al. (1995) *EMBO J* 14:4628-4638; the V-BASE directory (VBASE2-Retter et al., Nucleic Acid Res. 33; 671-674, 2005) which provides a comprehensive directory of human immunoglobulin variable region sequences (compiled by Tomlinson, I. A. et al. MRC Centre for Protein Engineering, Cambridge, UK); or consensus human FRs described, for example, in U.S. Pat. No. 6,300, 064.

CDR grafting and humanized antibodies are described, for example, in U.S. Pat. Nos. 6,180,370 and 5,693,762. For further details, see, e.g., Jones et al., 1986, PMID: 3713831); and U.S. Pat. Nos. 6,982,321 and 7,087,409.

Another method is termed "humaneering" which is described, for example, in U.S.P.N. 2005/0008625. In another embodiment a non-human antibody may be modified by specific deletion of human T-cell epitopes or "deimmunization" by the methods disclosed in WO 98/52976 and WO 00/34317.

As discussed above in selected embodiments at least 60%, 65%, 70%, 75%, or 80% of the humanized or CDR grafted antibody heavy or light chain variable region amino acid residues will correspond to those of the recipient human sequences. In other embodiments at least 83%, 85%, 87% or 90% of the humanized antibody variable region residues will correspond to those of the recipient human sequences. In a further preferred embodiment, greater than 95% of each of the humanized antibody variable regions will correspond to those of the recipient human sequences.

The sequence identity or homology of the humanized antibody variable region to the human acceptor variable region may be determined as previously discussed and, when measured as such, will preferably share at least 60% or 65% sequence identity, more preferably at least 70%, 75%, 80%, 85%, or 90% sequence identity, even more preferably at least 93%, 95%, 98% or 99% sequence identity. Preferably, residue positions which are not identical differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of similarity may be adjusted upwards to correct for the conservative nature of the substitution.

d. Human Antibodies

In another embodiment, the antibodies may comprise fully human antibodies. The term "human antibody" refers to an antibody which possesses an amino acid sequence that corresponds to that of an antibody produced by a human and/or has been made using any of the techniques for making human antibodies.

Human antibodies can be produced using various techniques known in the art. One technique is phage display in which a library of (preferably human) antibodies is synthesized on phages, the library is screened with the antigen of interest or an antibody-binding portion thereof, and the phage that binds the antigen is isolated, from which one may obtain the immunoreactive fragments. Methods for preparing and screening such libraries are well known in the art and kits for generating phage display libraries are commercially available (e.g., the Pharmacia Recombinant Phage Antibody System, catalog no. 27-9400-01; and the Stratagene SurfZAP™ phage display kit, catalog no. 240612). There also are other methods and reagents that can be used in generating and screening antibody display libraries (see, e.g., U.S. Pat. No. 5,223,409; PCT Publication Nos. WO 92/18619, WO 91/17271, WO 92/20791, WO 92/15679, WO 93/01288, WO 92/01047, WO 92/09690; and Barbas et al., *Proc. Natl. Acad. Sci. USA* 88:7978-7982 (1991)).

In one embodiment, recombinant human antibodies may be isolated by screening a recombinant combinatorial antibody library prepared as above. In one embodiment, the library is a scFv phage display library, generated using human $V_L$ and $V_H$ cDNAs prepared from mRNA isolated from B-cells.

The antibodies produced by naive libraries (either natural or synthetic) can be of moderate affinity ($K_a$ of about $10^6$ to $10^7$ $M^{-1}$), but affinity maturation can also be mimicked in vitro by constructing and reselecting from secondary libraries as described in the art. For example, mutation can be introduced at random in vitro by using error-prone polymerase (reported in Leung et al., *Technique*, 1: 11-15 (1989)). Additionally, affinity maturation can be performed by randomly mutating one or more CDRs, e.g. using PCR with primers carrying random sequence spanning the CDR of interest, in selected individual Fv clones and screening for higher-affinity clones. WO 9607754 described a method for inducing mutagenesis in a CDR of an immunoglobulin light chain to create a library of light chain genes. Another effective approach is to recombine the $V_H$ or $V_L$ domains selected by phage display with repertoires of naturally occurring V domain variants obtained from unimmunized donors and to screen for higher affinity in several rounds of chain reshuffling as described in Marks et al., *Biotechnol.*, 10: 779-783 (1992). This technique allows the production of antibodies and antibody fragments with a dissociation constant $K_D$ ($k_{off}/k_{on}$) of about $10^{-9}$ M or less.

In other embodiments, similar procedures may be employed using libraries comprising eukaryotic cells (e.g., yeast) that express binding pairs on their surface. See, for example, U.S. Pat. No. 7,700,302 and U.S. Ser. No. 12/404,059. In one embodiment, the human antibody is selected from a phage library, where that phage library expresses human antibodies (Vaughan et al. *Nature Biotechnology* 14:309-314 (1996): Sheets et al. *Proc. Natl. Acad. Sci. USA* 95:6157-6162 (1998). In other embodiments, human binding pairs may be isolated from combinatorial antibody libraries generated in eukaryotic cells such as yeast. See e.g., U.S. Pat. No. 7,700,302. Such techniques advantageously allow for the screening of large numbers of candidate modulators and provide for relatively easy manipulation of candidate sequences (e.g., by affinity maturation or recombinant shuffling).

Human antibodies can also be made by introducing human immunoglobulin loci into transgenic animals, e.g., mice in which the endogenous immunoglobulin genes have been partially or completely inactivated and human immunoglobulin genes have been introduced. Upon challenge, human antibody production is observed, which closely resembles that seen in humans in all respects, including gene rearrangement, assembly, and antibody repertoire. This approach is described, for example, in U.S. Pat. Nos. 5,545,807; 5,545,806; 5,569,825; 5,625,126; 5,633,425; 5,661,016, and U.S. Pat. Nos. 6,075,181 and 6,150,584 regarding XenoMouse® technology; and Lonberg and Huszar, *Intern. Rev. Immunol.* 13:65-93 (1995). Alternatively, the human antibody may be prepared via immortalization of human B lymphocytes producing an antibody directed against a target antigen (such B lymphocytes may be recovered from an individual suffering from a neoplastic disorder or may have been immunized in vitro). See, e.g., Cole et al., *Monoclonal Antibodies and Cancer Therapy*, Alan R. Liss, p. 77 (1985); Boerner et al., *J. Immunol*, 147 (1):86-95 (1991); and U.S. Pat. No. 5,750,373.

3. Recombinant Production of Antibodies

Antibodies and fragments thereof may be produced or modified using genetic material obtained from antibody producing cells and recombinant technology (see, for example, Berger and Kimmel, Guide to Molecular Cloning Techniques, *Methods in Enzymology* vol. 152 Academic Press, Inc., San Diego, Calif.; Sambrook and Russell (Eds.) (2000) *Molecular Cloning: A Laboratory Manual* ($3^{rd}$ Ed.), NY, Cold Spring Harbor Laboratory Press; Ausubel et al. (2002) *Short Protocols in Molecular Biology: A Compendium of Methods from Current Protocols in Molecular Biology*, Wiley, John & Sons, Inc. (supplemented through 2006); and U.S. Pat. No. 7,709,611).

More particularly, another aspect of the invention pertains to nucleic acid molecules that encode the antibodies of the invention. The nucleic acids may be present in whole cells, in a cell lysate, or in a partially purified or substantially pure form. A nucleic acid is "isolated" or "rendered substantially pure" when purified away from other cellular components or other contaminants, e.g., other cellular nucleic acids or proteins, by standard techniques, including alkaline/SDS treatment, CsCl banding, column chromatography, agarose gel electrophoresis and others well known in the art. A nucleic acid of the invention can be, for example, DNA or RNA and may or may not contain intronic sequences. More generally the term "nucleic acid", as used herein, includes genomic DNA, cDNA, RNA and artificial variants thereof (e.g., peptide nucleic acids), whether single-stranded or double-stranded. In a preferred embodiment, the nucleic acid is a cDNA molecule.

Nucleic acids of the invention can be obtained using standard molecular biology techniques. For antibodies expressed by hybridomas (e.g., hybridomas prepared from transgenic mice carrying human immunoglobulin genes as described further below), cDNAs encoding the light and heavy chains of the antibody made by the hybridoma can be obtained by standard PCR amplification or cDNA cloning techniques. For antibodies obtained from an immunoglobulin gene library (e.g., using phage display techniques), nucleic acid encoding the antibody can be recovered from the library.

Once DNA fragments encoding $V_H$ and $V_L$ segments are obtained, these DNA fragments can be further manipulated by standard recombinant DNA techniques, for example to convert the variable region genes to full-length antibody chain genes, to Fab fragment genes or to a scFv gene. In these manipulations, a $V_L$- or $V_H$-encoding DNA fragment is operatively linked to another DNA fragment encoding another protein, such as an antibody constant region or a flexible linker. The term "operatively linked", as used in this context, is intended to mean that the two DNA fragments are joined such that the amino acid sequences encoded by the two DNA fragments remain in-frame.

The isolated DNA encoding the $V_H$ region can be converted to a full-length heavy chain gene by operatively linking the $V_H$-encoding DNA to another DNA molecule encoding heavy chain constant regions ($C_H1$, $C_H2$ and $C_H3$). The sequences of human heavy chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The heavy chain constant region can be an IgG1, IgG2, IgG3, IgG4, IgA, IgE, IgM or IgD constant region, but most preferably is an IgG1 or IgG4 constant region. As discussed in more detail below an exemplary IgG1 constant region that is compatible with the teachings herein is set forth as SEQ ID NO: 6 in the appended sequence listing. For a Fab fragment heavy chain gene, the VH-encoding DNA can be operatively linked to another DNA molecule encoding only the heavy chain CH1 constant region.

The isolated DNA encoding the $V_L$ region can be converted to a full-length light chain gene (as well as a Fab light chain gene) by operatively linking the $V_L$-encoding DNA to another DNA molecule encoding the light chain constant region, $C_L$. The sequences of human light chain constant region genes are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification. The light chain constant region can be a kappa or lambda constant region, but most preferably is a kappa constant region. In this respect an exemplary compatible kappa light chain constant region is set forth as SEQ ID NO: 5 in the appended sequence listing.

The instant invention also provides vectors comprising such nucleic acids described above, which may be operably linked to a promoter (see, e.g., WO 86/05807; WO 89/01036; and U.S. Pat. No. 5,122,464); and other transcriptional regulatory and processing control elements of the eukaryotic secretory pathway. The invention also provides host cells harboring those vectors and host-expression systems.

As used herein, the term "host-expression system" includes any kind of cellular system which can be engineered to generate either the nucleic acids or the polypeptides and antibodies of the invention. Such host-expression systems include, but are not limited to microorganisms (e.g., *E. coli* or *B. subtilis*) transformed or transfected with recombinant bacteriophage DNA or plasmid DNA; yeast (e.g., *Saccharomyces*) transfected with recombinant yeast expression vectors; or mammalian cells (e.g., COS, CHO—S, HEK-293T, 3T3 cells) harboring recombinant expression constructs containing promoters derived from the genome of mammalian cells or viruses (e.g., the adenovirus late promoter). The host cell may be co-transfected with two expression vectors, for example, the first vector encoding a heavy chain derived polypeptide and the second vector encoding a light chain derived polypeptide.

Methods of transforming mammalian cells are well known in the art. See, for example, U.S. Pat. Nos. 4,399,216, 4,912,040, 4,740,461, and 4,959,455. The host cell may also be engineered to allow the production of an antigen binding molecule with various characteristics (e.g. modified glycoforms or proteins having GnTIII activity).

For long-term, high-yield production of recombinant proteins stable expression is preferred. Accordingly, cell lines that stably express the selected antibody may be engineered using standard art recognized techniques and form part of the invention. Rather than using expression vectors that contain viral origins of replication, host cells can be transformed with DNA controlled by appropriate expression control elements (e.g., promoter or enhancer sequences, transcription terminators, polyadenylation sites, etc.), and a selectable marker. Any of the selection systems well known in the art may be used, including the glutamine synthetase gene expression system (the GS system) which provides an efficient approach for enhancing expression under certain conditions. The GS system is discussed in whole or part in connection with EP 0 216 846, EP 0 256 055, EP 0 323 997 and EP 0 338 841 and U.S. Pat. Nos. 5,591,639 and 5,879,936. Another preferred expression system for the development of stable cell lines is the Freedom™ CHO—S Kit (Life Technologies).

Once an antibody of the invention has been produced by recombinant expression or any other of the disclosed techniques, it may be purified or isolated by methods known in the art, meaning that it is identified and separated and/or recovered from its natural environment and separated from contaminants that would interfere with diagnostic or therapeutic uses for the antibody. Isolated antibodies include antibodies in situ within recombinant cells.

These isolated preparations may be purified using various art recognized techniques, such as, for example, ion exchange and size exclusion chromatography, dialysis, diafiltration, and affinity chromatography, particularly Protein A or Protein G affinity chromatography.

4. Post-Production Selection

No matter how obtained, antibody-producing cells (e.g., hybridomas, yeast colonies, etc.) may be selected, cloned and further screened for desirable characteristics including, for example, robust growth, high antibody production and desirable antibody characteristics such as high affinity for the antigen of interest. Hybridomas can be expanded in vitro in cell culture or in vivo in syngeneic immunocompromised animals. Methods of selecting, cloning and expanding hybridomas and/or colonies are well known to those of ordinary skill in the art. Once the desired antibodies are identified the relevant genetic material may be isolated, manipulated and expressed using common, art-recognized molecular biology and biochemical techniques.

The antibodies produced by naïve libraries (either natural or synthetic) may be of moderate affinity ($K_a$ of about $10^6$ to $10^7$ $M^{-1}$). To enhance affinity, affinity maturation may be mimicked in vitro by constructing antibody libraries (e.g., by introducing random mutations in vitro by using error-prone polymerase) and reselecting antibodies with high affinity for the antigen from those secondary libraries (e.g. by using phage or yeast display). WO 9607754 describes a method for inducing mutagenesis in a CDR of an immunoglobulin light chain to create a library of light chain genes.

Various techniques can be used to select antibodies, including but not limited to, phage or yeast display in which a library of human combinatorial antibodies or scFv fragments is synthesized on phages or yeast, the library is screened with the antigen of interest or an antibody-binding portion thereof, and the phage or yeast that binds the antigen is isolated, from which one may obtain the antibodies or immunoreactive fragments (Vaughan et al., 1996, PMID: 9630891; Sheets et al., 1998, PMID: 9600934; Boder et al., 1997, PMID: 9181578; Pepper et al., 2008, PMID: 18336206). Kits for generating phage or yeast display libraries are commercially available. There also are other methods and reagents that can be used in generating and screening antibody display libraries (see U.S. Pat. No. 5,223,409; WO 92/18619, WO 91/17271, WO 92/20791, WO 92/15679, WO 93/01288, WO 92/01047, WO 92/09690; and Barbas et al., 1991, PMID: 1896445). Such techniques advantageously allow for the screening of large numbers of candidate antibodies and provide for relatively easy manipulation of sequences (e.g., by recombinant shuffling).

5. Antibody Fragments and Derivatives a. Fragments

Regardless of which form of the modulator (e.g. chimeric, humanized, etc.) is selected to practice the invention it will be appreciated that immunoreactive fragments of the same may be used in accordance with the teachings herein. An "antibody fragment" comprises at least a portion of an intact antibody. As used herein, the term "fragment" of an antibody molecule includes antigen-binding fragments of antibodies, and the term "antigen-binding fragment" refers to a polypeptide fragment of an immunoglobulin or antibody that immunospecifically binds or reacts with a selected antigen or immunogenic determinant thereof or competes with the intact antibody from which the fragments were derived for specific antigen binding.

Exemplary fragments include: $V_L$, $V_H$, scFv, F(ab')2 fragment, Fab fragment, Fd fragment, Fv fragment, single domain antibody fragments, diabodies, linear antibodies, single-chain antibody molecules and multispecific antibodies formed from antibody fragments. In addition, an active fragment comprises a portion of the antibody that retains its ability to interact with the antigen/substrates or receptors and modify them in a manner similar to that of an intact antibody (though maybe with somewhat less efficiency).

In other embodiments, an antibody fragment is one that comprises the Fc region and that retains at least one of the biological functions normally associated with the Fc region when present in an intact antibody, such as FcRn binding, antibody half-life modulation, ADCC function and complement binding. In one embodiment, an antibody fragment is a monovalent antibody that has an in vivo half-life substantially similar to an intact antibody. For example, such an antibody fragment may comprise an antigen binding arm linked to an Fc sequence capable of conferring in vivo stability to the fragment.

As would be well recognized by those skilled in the art, fragments can be obtained via chemical or enzymatic treatment (such as papain or pepsin) of an intact or complete antibody or antibody chain or by recombinant means. See, e.g., Fundamental Immunology, W. E. Paul, ed., Raven Press, N.Y. (1999), for a more detailed description of antibody fragments.

b. Multivalent Antibodies

In one embodiment, the modulators of the invention may be monovalent or multivalent (e.g., bivalent, trivalent, etc.). As used herein, the term "valency" refers to the number of potential target binding sites associated with an antibody. Each target binding site specifically binds one target molecule or specific position or locus on a target molecule. When an antibody is monovalent, each binding site of the molecule will specifically bind to a single antigen position or epitope. When an antibody comprises more than one target binding site (multivalent), each target binding site may specifically bind the same or different molecules (e.g., may bind to different ligands or different antigens, or different epitopes or positions on the same antigen). See, for example, U.S.P.N. 2009/0130105. In each case at least one of the binding sites will comprise an epitope, motif or domain associated with a DLL3 isoform.

In one embodiment, the modulators are bispecific antibodies in which the two chains have different specificities, as described in Millstein et al., 1983, *Nature*, 305:537-539. Other embodiments include antibodies with additional specificities such as trispecific antibodies. Other more sophisticated compatible multispecific constructs and methods of their fabrication are set forth in U.S.P.N. 2009/0155255, as well as WO 94/04690; Suresh et al., 1986, *Methods in Enzymology*, 121:210; and WO96/27011.

As alluded to above, multivalent antibodies may immunospecifically bind to different epitopes of the desired target molecule or may immunospecifically bind to both the target molecule as well as a heterologous epitope, such as a heterologous polypeptide or solid support material. While preferred embodiments of the anti-DLL3 antibodies only bind two antigens (i.e. bispecific antibodies), antibodies with additional specificities such as trispecific antibodies are also encompassed by the instant invention. Bispecific antibodies also include cross-linked or "heteroconjugate" antibodies. For example, one of the antibodies in the heteroconjugate can be coupled to avidin, the other to biotin. Such antibodies have, for example, been proposed to target immune system cells to unwanted cells (U.S. Pat. No. 4,676,980), and for treatment of HIV infection (WO 91/00360, WO 92/200373, and EP 03089). Heteroconjugate antibodies may be made using any convenient cross-linking methods. Suitable cross-linking agents are well known in the art, and are disclosed in U.S. Pat. No. 4,676,980, along with a number of cross-linking techniques.

In yet other embodiments, antibody variable domains with the desired binding specificities (antibody-antigen combining sites) are fused to immunoglobulin constant domain sequences, such as an immunoglobulin heavy chain constant domain comprising at least part of the hinge, $C_H2$, and/or $C_H3$ regions, using methods well known to those of ordinary skill in the art.

c. Fc Region Modifications

In addition to the various modifications, substitutions, additions or deletions to the variable or binding region of the disclosed antibodies set forth above, those skilled in the art will appreciate that selected embodiments of the present invention may also comprise substitutions or modifications of the constant region (i.e. the Fc region). More particularly, it is contemplated that the DLL3 modulators of the invention may contain inter alia one or more additional amino acid residue substitutions, mutations and/or modifications which result in a compound with preferred characteristics including, but not limited to: altered pharmacokinetics, increased serum half life, increase binding affinity, reduced immunogenicity, increased production, altered Fc ligand binding to an Fc receptor (FcR), enhanced or reduced "ADCC" (antibody-dependent cell mediated cytotoxicity) or "CDC" (complement-dependent cytotoxicity) activity, altered glycosylation and/or disulfide bonds and modified binding specificity. In this regard it will be appreciated that these Fc variants may advantageously be used to enhance the effective anti-neoplastic properties of the disclosed modulators.

To this end certain embodiments of the invention may comprise substitutions or modifications of the Fc region, for example the addition of one or more amino acid residue, substitutions, mutations and/or modifications to produce a compound with enhanced or preferred Fc effector functions. For example, changes in amino acid residues involved in the interaction between the Fc domain and an Fc receptor (e.g., FcγRI, FcγRIIA and B, FcγRIII and FcRn) may lead to increased cytotoxicity and/or altered pharmacokinetics, such as increased serum half-life (see, for example, Ravetch and Kinet, Annu. Rev. Immunol 9:457-92 (1991); Capel et al., Immunomethods 4:25-34 (1994); and de Haas et al., J. Lab. Clin. Med. 126:330-41 (1995) each of which is incorporated herein by reference).

In selected embodiments, antibodies with increased in vivo half-lives can be generated by modifying (e.g., substituting, deleting or adding) amino acid residues identified as involved in the interaction between the Fc domain and the FcRn receptor (see, e.g., International Publication Nos. WO 97/34631; WO 04/029207; U.S. Pat. No. 6,737,056 and U.S.P.N. 2003/0190311. With regard to such embodiments, Fc variants may provide half-lives in a mammal, preferably a human, of greater than 5 days, greater than 10 days, greater than 15 days, preferably greater than 20 days, greater than 25 days, greater than 30 days, greater than 35 days, greater than 40 days, greater than 45 days, greater than 2 months, greater than 3 months, greater than 4 months, or greater than 5 months. The increased half-life results in a higher serum titer which thus reduces the frequency of the administration of the antibodies and/or reduces the concentration of the antibodies to be administered. Binding to human FcRn in vivo and serum half life of human FcRn high affinity binding polypeptides can be assayed, e.g., in transgenic mice or transfected human cell lines expressing human FcRn, or in primates to which the polypeptides with a variant Fc region are administered. WO 2000/42072 describes antibody variants with improved or diminished binding to FcRns. See also, e.g., Shields et al. J. Biol. Chem. 9(2):6591-6604 (2001).

In other embodiments, Fc alterations may lead to enhanced or reduced ADCC or CDC activity. As in known in the art, CDC refers to the lysing of a target cell in the presence of complement, and ADCC refers to a form of cytotoxicity in which secreted Ig bound onto FcRs present on certain cytotoxic cells (e.g., Natural Killer cells, neutrophils, and macrophages) enables these cytotoxic effector cells to bind specifically to an antigen-bearing target cell and subsequently kill the target cell with cytotoxins. In the context of the instant invention antibody variants are provided with "altered" FcR binding affinity, which is either enhanced or diminished binding as compared to a parent or unmodified antibody or to an antibody comprising a native sequence FcR. Such variants which display decreased binding may possess little or no appreciable binding, e.g., 0-20% binding to the FcR compared to a native sequence, e.g. as determined by techniques well known in the art. In other embodiments the variant will exhibit enhanced binding as compared to the native immunoglobulin Fc domain. It will be appreciated that these types of Fc variants may advantageously be used to enhance the effective anti-neoplastic properties of the disclosed antibodies. In yet other embodiments, such alterations lead to increased binding affinity, reduced immunogenicity, increased production, altered glycosylation and/or disulfide bonds (e.g., for conjugation sites), modified binding specificity, increased phagocytosis; and/or down regulation of cell surface receptors (e.g. B cell receptor; BCR), etc.

d. Altered Glycosylation

Still other embodiments comprise one or more engineered glycoforms, i.e., a DLL3 modulator comprising an altered glycosylation pattern or altered carbohydrate composition that is covalently attached to the protein (e.g., in the Fc domain). See, for example, Shields, R. L. et al. (2002) *J. Biol. Chem.* 277:26733-26740. Engineered glycoforms may be useful for a variety of purposes, including but not limited to enhancing or reducing effector function, increasing the affinity of the modulator for a target or facilitating production of the modulator. In certain embodiments where reduced effector function is desired, the molecule may be engineered to express an aglycosylated form. Substitutions that may result in elimination of one or more variable region framework glycosylation sites to thereby eliminate glycosylation at that site are well known (see e.g. U.S. Pat. Nos. 5,714,350 and 6,350,861). Conversely, enhanced effector functions or improved binding may be imparted to the Fc containing molecule by engineering in one or more additional glycosylation sites.

Other embodiments include an Fc variant that has an altered glycosylation composition, such as a hypofucosylated antibody having reduced amounts of fucosyl residues or an antibody having increased bisecting GlcNAc structures. Such altered glycosylation patterns have been demonstrated to increase the ADCC ability of antibodies. Engineered glycoforms may be generated by any method known to one skilled in the art, for example by using engineered or variant expression strains, by co-expression with one or more enzymes (for example N-acetylglucosaminyltransferase III (GnTI11)), by expressing a molecule comprising an Fc region in various organisms or cell lines from various organisms or by modifying carbohydrate(s) after the molecule comprising Fc region has been expressed (see, for example, WO 2012/117002).

e. Additional Processing

The modulators may be differentially modified during or after production, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited, to specific chemical cleavage by cyanogen bromide, trypsin, chymotrypsin, papain, V8 protease, $NaBH_4$, acetylation, formylation, oxidation, reduction, metabolic synthesis in the presence of tunicamycin, etc.

Various post-translational modifications also encompassed by the invention include, for example, N-linked or O-linked carbohydrate chains, processing of N-terminal or C-terminal ends, attachment of chemical moieties to the amino acid backbone, chemical modifications of N-linked or O-linked carbohydrate chains, and addition or deletion of an N-terminal methionine residue as a result of prokaryotic host cell expression. Moreover, the modulators may also be modified with a detectable label, such as an enzymatic, fluorescent, radioisotopic or affinity label to allow for detection and isolation of the modulator.

6. Antibody Characteristics

No matter how obtained or which of the aforementioned forms the modulator takes, various embodiments of the disclosed modulators may exhibit certain characteristics. In selected embodiments, antibody-producing cells (e.g., hybridomas or yeast colonies) may be selected, cloned and further screened for favorable properties including, for example, robust growth, high modulator production and, as discussed in more detail below, desirable modulator characteristics. In other cases characteristics of the modulator may be imparted or influenced by selecting a particular antigen (e.g., a specific DLL3 isoform) or immunoreactive fragment of the target antigen for inoculation of the animal. In still other embodiments the selected modulators may be engineered as described above to enhance or refine immunochemical characteristics such as affinity or pharmacokinetics.

a. Neutralizing Antibodies

In certain embodiments, the conjugates will comprise "neutralizing" antibodies or derivatives or fragments thereof. That is, the present invention may comprise antibody molecules that bind specific domains, motifs or epitopes and are capable of blocking, reducing or inhibiting the biological activity of DLL3. More generally the term "neutralizing antibody" refers to an antibody that binds to or interacts with a target molecule or ligand and prevents binding or association of the target molecule to a binding partner such as a receptor or substrate, thereby interrupting a biological response that otherwise would result from the interaction of the molecules.

It will be appreciated that competitive binding assays known in the art may be used to assess the binding and specificity of an antibody or immunologically functional fragment or derivative thereof. With regard to the instant invention an antibody or fragment will be held to inhibit or reduce binding of DLL3 to a binding partner or substrate when an excess of antibody reduces the quantity of binding partner bound to DLL3 by at least about 20%, 30%, 40%, 50%, 60%, 70%, 80%, 85%, 90%, 95%, 97%, 99% or more as measured, for example, by Notch receptor activity or in an in vitro competitive binding assay. In the case of antibodies to DLL3 for example, a neutralizing antibody or antagonist will preferably alter Notch receptor activity by at least about 20%, 30%, 40%, 50%, 60%, 70%, 80%, 85%, 90%, 95%, 97%, 99% or more. It will be appreciated that this modified activity may be measured directly using art-recognized techniques or may be measured by the impact the altered activity has downstream (e.g., oncogenesis, cell survival or activation or suppression of Notch responsive genes). Preferably, the ability of an antibody to neutralize DLL3 activity is assessed by inhibition of DLL3 binding to a Notch receptor or by assessing its ability to relieve DLL3 mediated repression of Notch signaling.

b. Internalizing Antibodies

There is evidence that a substantial portion of expressed DLL3 protein remains associated with the tumorigenic cell surface, thereby allowing for localization and internalization of the disclosed modulators. In preferred embodiments such modulators may be associated with, or conjugated to, anti-cancer agents such as cytotoxic moieties that kill the cell upon internalization. In particularly preferred embodiments the modulator will comprise an internalizing antibody drug conjugate.

As used herein, a modulator that "internalizes" is one that is taken up (along with any payload) by the cell upon binding to an associated antigen or receptor. As will be appreciated, the internalizing modulator may, in preferred embodiments, comprise an antibody including antibody fragments and derivatives thereof, as well as antibody conjugates. Internalization may occur in vitro or in vivo. For therapeutic applications, internalization will preferably occur in vivo in a subject in need thereof. The number of antibody molecules internalized may be sufficient or adequate to kill an antigen-expressing cell, especially an antigen-expressing cancer stem cell. Depending on the potency of the antibody or antibody conjugate, in some instances, the uptake of a single antibody molecule into the cell is sufficient to kill the target cell to which the antibody binds. For example, certain toxins are so highly potent that the internalization of a few molecules of the toxin conjugated to the antibody is sufficient to kill the tumor cell. Whether an antibody internalizes upon binding to a mammalian cell can be determined by various art-recognized assays including those described in the Examples below. Methods of detecting whether an antibody internalizes into a cell are also described in U.S. Pat. No. 7,619,068 which is incorporated herein by reference in its entirety.

c. Depleting Antibodies

In other embodiments the antibodies will comprise depleting antibodies or derivatives or fragments thereof. The term "depleting" antibody refers to an antibody that preferably binds to or associates with an antigen on or near the cell surface and induces, promotes or causes the death or elimination of the cell (e.g., by CDC, ADCC or introduction of a cytotoxic agent). In some embodiments, the selected depleting antibodies will be associated or conjugated to a cytotoxic agent.

Preferably a depleting antibody will be able to remove, incapacitate, eliminate or kill at least 20%, 30%, 40%, 50%, 60%, 70%, 80%, 85%, 90%, 95%, 97%, or 99% of DLL3 tumorigenic cells in a defined cell population. In some embodiments the cell population may comprise enriched, sectioned, purified or isolated tumor perpetuating cells. In other embodiments the cell population may comprise whole tumor samples or heterogeneous tumor extracts that comprise tumor perpetuating cells. Those skilled in the art will appreciate that standard biochemical techniques as described in the Examples below (e.g., Examples 8 to 10) may be used to monitor and quantify the depletion of tumorigenic cells or tumor perpetuating cells in accordance with the teachings herein.

d. Binning and Epitope Mapping

It will further be appreciated the disclosed anti-DLL3 antibody modulators will associate with, or bind to, discrete epitopes or immunogenic determinants presented by the selected target or fragment thereof. In certain embodiments, epitope or immunogenic determinants include chemically active surface groupings of molecules such as amino acids, sugar side chains, phosphoryl groups, or sulfonyl groups, and, in certain embodiments, may have specific three-dimensional structural characteristics, and/or specific charge characteristics. Thus, as used herein the term "epitope" includes any protein determinant capable of specific binding to an immunoglobulin or T-cell receptor or otherwise interacting with a molecule. In certain embodiments, an antibody is said to specifically bind (or immunospecifically bind or react) an antigen when it preferentially recognizes its target antigen in a complex mixture of proteins and/or macromolecules. In preferred embodiments, an antibody is said to specifically bind an antigen when the equilibrium dissociation constant ($K_D$) is less than or equal to $10^{-6}$M or less than or equal to $10^{-7}$M, more preferably when the equilibrium dissociation constant is less than or equal to $10^{-8}$M, and even more preferably when the dissociation constant is less than or equal to $10^{-9}$M More directly the term "epitope" is used in its common biochemical sense and refers to that portion of the target antigen capable of being recognized and specifically bound by a particular antibody modulator. When the antigen is a polypeptide such as DLL3, epitopes may generally be formed from both contiguous amino acids and noncontiguous amino acids juxtaposed by tertiary folding of a protein ("conformational epitopes"). In such conformational epitopes the points of interaction occur across amino acid residues on the protein that are linearly separated from one another. Epitopes formed from contiguous amino acids (sometimes referred to as "linear" or "continuous" epitopes) are typically retained upon protein denaturing, whereas epitopes formed by tertiary folding are typically lost upon protein denaturing. In any event an antibody epitope typically includes at least 3, and more usually, at least 5 or 8-10 amino acids in a unique spatial conformation.

In this respect it will be appreciated that, in certain embodiments, an epitope may be associated with, or reside in, one or more regions, domains or motifs of the DLL3 protein (e.g., amino acids 1-618 of isoform 1). As discussed in more detail herein the extracellular region of the DLL3 protein comprises a series of generally recognized domains including six EGF-like domains and a DSL domain. For the purposes of the instant disclosure the term "domain" will be used in accordance with its generally accepted meaning and will be held to refer to an identifiable or definable conserved structural entity within a protein that exhibits a distinctive secondary structure content. In many cases, homologous domains with common functions will usually show sequence similarities and be found in a number of disparate proteins (e.g., EGF-like domains are reportedly found in at least 471 different proteins). Similarly, the art-recognized term "motif" will be used in accordance with its common meaning and shall generally refer to a short, conserved region of a protein that is typically ten to twenty contiguous amino acid residues. As discussed throughout, selected embodiments comprise modulators that associate with or bind to an epitope within specific regions, domains or motifs of DLL3.

In any event once a desired epitope on an antigen is determined, it is possible to generate antibodies to that epitope, e.g., by immunizing with a peptide comprising the epitope using techniques described in the present invention. Alternatively, during the discovery process, the generation and characterization of antibodies may elucidate information about desirable epitopes located in specific domains or motifs. From this information, it is then possible to competitively screen antibodies for binding to the same epitope. An approach to achieve this is to conduct competition studies to find antibodies that competitively bind with one another, i.e. the antibodies compete for binding to the antigen. A high throughput process for binning antibodies based upon their cross-competition is described in WO 03/48731. Other methods of binning or domain level or epitope mapping comprising modulator competition or antigen fragment expression on yeast is set forth in the Examples below.

As used herein, the term "binning" refers to methods used to group or classify antibodies based on their antigen binding characteristics and competition. While the techniques are useful for defining and categorizing modulators of the instant invention, the bins do not always directly correlate with epitopes and such initial determinations of epitope binding may be further refined and confirmed by other art-recognized methodology as described herein. However, as discussed and shown in the Examples below, empirical assignment of antibody modulators to individual bins provides information that may be indicative of the therapeutic potential of the disclosed modulators.

More specifically, one can determine whether a selected reference antibody (or fragment thereof) binds to the same epitope or cross competes for binding with a second test antibody (i.e., is in the same bin) by using methods known in the art and set forth in the Examples herein. In one embodiment, a reference antibody modulator is associated with DLL3 antigen under saturating conditions and then the ability of a secondary or test antibody modulator to bind to DLL3 is determined using standard immunochemical techniques. If the test antibody is able to substantially bind to DLL3 at the same time as the reference anti-DLL3 antibody, then the secondary or test antibody binds to a different epitope than the primary or reference antibody. However, if the test antibody is not able to substantially bind to DLL3 at the same time, then the test antibody binds to the same epitope, an overlapping epitope, or an epitope that is in close proximity (at least sterically) to the epitope bound by the primary antibody. That is, the test antibody competes for antigen binding and is in the same bin as the reference antibody.

The term "compete" or "competing antibody" when used in the context of the disclosed modulators means competition between antibodies as determined by an assay in which a test antibody or immunologically functional fragment under test prevents or inhibits specific binding of a reference antibody to a common antigen. Typically, such an assay involves the use of purified antigen (e.g., DLL3 or a domain or fragment thereof) bound to a solid surface or cells bearing either of these, an unlabeled test immunoglobulin and a labeled reference immunoglobulin. Competitive inhibition is measured by determining the amount of label bound to the solid surface or cells in the presence of the test immunoglobulin. Usually the test immunoglobulin is present in excess and/or allowed to bind first. Antibodies identified by competition assay (competing antibodies) include antibodies binding to the same epitope as the reference antibody and antibodies binding to an adjacent epitope sufficiently proximal to the epitope bound by the reference antibody for steric hindrance to occur. Additional details regarding methods for determining competitive binding are provided in the Examples herein. Usually, when a competing antibody is present in excess, it will inhibit specific binding of a reference antibody to a common antigen by at least 30%, 40%, 45%, 50%, 55%, 60%, 65%, 70% or 75%. In some instance, binding is inhibited by at least 80%, 85%, 90%, 95%, or 97% or more.

Conversely, when the reference antibody is bound it will preferably inhibit binding of a subsequently added test antibody (i.e., a DLL3 modulator) by at least 30%, 40%, 45%, 50%, 55%, 60%, 65%, 70% or 75%. In some instance, binding of the test antibody is inhibited by at least 80%, 85%, 90%, 95%, or 97% or more.

With regard to the instant invention, and as set forth in the Examples below, it has been determined (via surface plasmon resonance or bio-layer interferometry) that the extracellular domain of DLL3 defines at least nine bins by competitive binding termed "bin A" to "bin I" herein. Given the resolution provided by modulator binning techniques, it is believed that these nine bins comprise the majority of the bins that are present in the extracellular region of the DLL3 protein.

In this respect, and as known in the art and detailed in the Examples below, the desired binning or competitive binding data can be obtained using solid phase direct or indirect radioimmunoassay (RIA), solid phase direct or indirect enzyme immunoassay (EIA or ELISA), sandwich competition assay, a Biacore™ 2000 system (i.e., surface plasmon resonance—GE Healthcare), a ForteBio® Analyzer (i.e., bio-layer interferometry—ForteBio, Inc.) or flow cytometric methodology. The term "surface plasmon resonance," as used herein, refers to an optical phenomenon that allows for the analysis of real-time specific interactions by detection of alterations in protein concentrations within a biosensor matrix. The term "bio-layer interferometry" refers to an optical analytical technique that analyzes the interference pattern of white light reflected from two surfaces: a layer of immobilized protein on a biosensor tip, and an internal reference layer. Any change in the number of molecules bound to the biosensor tip causes a shift in the interference pattern that can be measured in real-time. In particularly preferred embodiments the analysis (whether surface plasmon resonance, bio-layer interferometry or flow cytometry) is performed using a Biacore or ForteBio instrument or a flow cytometer (e.g., FACSAria II) as demonstrated in the Examples below.

In order to further characterize the epitopes that the disclosed DLL3 antibody modulators associate with or bind to, domain-level epitope mapping was performed using a modification of the protocol described by Cochran et al. (J Immunol Methods. 287 (1-2):147-158 (2004) which is incorporated herein by reference). Briefly, individual domains of DLL3 comprising specific amino acid sequences were expressed on the surface of yeast and binding by each DLL3 antibody was determined through flow cytometry. The results are discussed below in Example 6 and shown in FIG. 4.

Other compatible epitope mapping techniques include alanine scanning mutants, peptide blots (Reineke (2004) Methods Mol Biol 248:443-63) (herein specifically incorporated by reference in its entirety), or peptide cleavage analysis. In addition, methods such as epitope excision, epitope extraction and chemical modification of antigens can be employed (Tomer (2000) Protein Science 9: 487-496) (herein specifically incorporated by reference in its entirety). In other embodiments Modification-Assisted Profiling (MAP), also known as Antigen Structure-based Antibody Profiling (ASAP) provides a method that categorizes large numbers of monoclonal antibodies (mAbs) directed against the same antigen according to the similarities of the binding profile of each antibody to chemically or enzymatically modified antigen surfaces (U.S.P.N. 2004/0101920, herein specifically incorporated by reference in its entirety). Each category may reflect a unique epitope either distinctly different from or partially overlapping with epitope represented by another category. This technology allows rapid filtering of genetically identical antibodies, such that characterization can be focused on genetically distinct antibodies. It will be appreciated that MAP may be used to sort the hDLL3 antibody modulators of the invention into groups of antibodies binding different epitopes Agents useful for altering the structure of the immobilized antigen include enzymes such as proteolytic enzymes (e.g., trypsin, endoproteinase Glu-C, endoproteinase Asp-N, chymotrypsin, etc.). Agents useful for altering the structure of the immobilized antigen may also be chemical agents, such as, succinimidyl esters and their derivatives, primary amine-containing compounds, hydrazines and carbohydrazines, free amino acids, etc.

The antigen protein may be immobilized on either biosensor chip surfaces or polystyrene beads. The latter can be processed with, for example, an assay such as multiplex LUMINEX™ detection assay (Luminex Corp.). Because of the capacity of LUMINEX to handle multiplex analysis with up to 100 different types of beads, LUMINEX provides almost unlimited antigen surfaces with various modifications, resulting in improved resolution in antibody epitope profiling over a biosensor assay.

e. Binding Affinity

Besides epitope specificity the disclosed antibodies may be characterized using physical characteristics such as, for example, binding affinities. In this regard the present invention further encompasses the use of antibodies that have a high binding affinity for one or more DLL3 isoforms or, in the case of pan-antibodies, more than one member of the DLL family. As used herein, the term "high affinity" for an IgG antibody refers to an antibody having a $K_D$ of $10^{-8}$ M or less, more preferably $10^{-9}$ M or less and even more preferably $10^{-10}$M or less for a target antigen. However, "high affinity" binding can vary for other antibody isotypes. For example, "high affinity" binding for an IgM isotype refers to an antibody having a $K_D$ of $10^{-7}$ M or less, more preferably $10^{-8}$ M or less, even more preferably $10^{-9}$ M or less.

The term "$K_D$", as used herein, is intended to refer to the dissociation constant of a particular antibody-antigen interaction. An antibody of the invention is said to immunospecifically bind its target antigen when the dissociation constant $K_D$ ($k_{off}/k_{on}$) is $\leq 10^{-7}$M. The antibody specifically binds antigen with high affinity when the $K_D$ is $\leq 5\times 10^{-9}$M, and with very high affinity when the $K_D$ is $\leq 5\times 10^{-10}$M. In one embodiment of the invention, the antibody has a $K_D$ of $\leq 10^{-9}$M and an off-rate of about $1\times 10^{-4}$/sec. In one embodiment of the invention, the off-rate is $<1\times 10^{-5}$/sec. In other embodiments of the invention, the antibodies will bind to DLL3 with a $K_D$ of between about $10^{-7}$M and $10^{-10}$M, and in yet another embodiment it will bind with a $K_D \leq 2\times 10^{-10}$M. Still other selected embodiments of the present invention comprise antibodies that have a disassociation constant or $K_D$ ($k_{off}/k_{on}$) of less than $10^{-2}$M, less than $5\times 10^{-2}$M, less than $10^{-3}$M, less than $5\times 10^{-3}$M, less than $10^{-4}$M, less than $5\times 10^{-4}$M, less than $10^{-5}$M, less than $5\times 10^{-5}$M, less than $10^{-6}$M, less than $5\times 10^{-6}$M, less than $10^{-7}$M, less than $5\times 10^{-7}$M, less than $10^{-8}$M, less than $5\times 10^{-8}$M, less than $10^{-9}$M, less than $5\times 10^{-9}$M, less than $10^{-10}$M, less than $5\times 10^{-10}$M, less than $10^{-11}$M, less than $5\times 10^{-11}$M, less than $10^{-12}$M, less than $5\times 10^{-12}$M, less than $10^{-13}$M, less than $5\times 10^{-13}$M, less than $10^{-14}$M, less than $5\times 10^{-14}$M, less than $10^{-15}$M or less than $5\times 10^{-15}$M.

In specific embodiments, an antibody of the invention that immunospecifically binds to DLL3 has an association rate constant or $k_{on}$ (or $k_a$) rate (DLL3 (Ab)+antigen (Ag) $\overset{k_{on}}{\leftarrow}$ Ab—Ag) of at least $10^5 M^{-1} s^{-1}$, at least $2\times 10^5 M^{-1} s^{-1}$, at least $5\times 10^5 M^{-1} s^{-1}$, at least $10^6 M^{-1} s^{-1}$, at least $5\times 10^6 M^{-1} s^{-1}$, at least $10^7 M^{-1} s^{-1}$, at least $5\times 10^7 M^{-1} s^{-1}$, or at least $10^8 M^{-1} s^{-1}$.

In another embodiment, an antibody of the invention that immunospecifically binds to DLL3 has a disassociation rate constant or $k_{off}$ (or $k_d$) rate (DLL3 (Ab)+antigen (Ag) $\overset{k_{off}}{\leftarrow}$ Ab—Ag) of less than $10^{-1} s^{-1}$, less than $5\times 10^{-1} s^{-1}$, less than $10^{-2} s^{-1}$, less than $5\times 10^{-2} s^{-1}$, less than $10^{-3} s^{-1}$, less than $5\times 10^{-3} s^{-1}$, less than $10^{-4} s^{-1}$, less than $5\times 10^{-4} s^{-1}$, less than $10^{-5} s^{-1}$, less than $5\times 10^{-5} s^{-1}$, less than $10^{-6} s^{-1}$, less than $5\times 10^{-6} s^{-1}$ less than $10^{-7} s^{-1}$, less than $5\times 10^{-7} s^{-1}$, less than $10^{-8} s^{-1}$, less than $5\times 10^{-8} s^{-1}$, less than $10^{-9} s^{-1}$, less than $5\times 10^{-9} s^{-1}$ or less than $10^{-10} s^{-1}$.

In other selected embodiments of the present invention anti-DLL3 antibodies will have an affinity constant or $K_a$ ($k_{on}/k_{off}$) of at least $10^2 M^{-1}$, at least $5\times 10^2 M^{-1}$, at least $10^3 M^{-1}$, at least $5\times 10^3 M^{-1}$, at least $10^4 M^{-1}$, at least $5\times 10^4 M^{-1}$, at least $10^5 M^{-1}$, at least $5\times 10^5 M^{-1}$, at least $10^6 M^{-1}$, at least $5\times 10^6 M^{-1}$, at least $10^7 M^{-1}$, at least $5\times 10^7 M^{-1}$, at least $10^8 M^{-1}$, at least $5\times 10^8 M^{-1}$, at least $10^9 M^{-1}$, at least $5\times 10^9 M^{-1}$, at least $10^{10} M^{-1}$, at least $5\times 10^{10} M^{-1}$, at least $10^{11} M^{-1}$, at least $5\times 10^{11} M^{-1}$, at least $10^{12} M^{-1}$, at least $5\times 10^{12} M^{-1}$, at least $10^{13} M^{-1}$, at least $5\times 10^{13} M^{-1}$, at least $10^{14} M^{-1}$, at least $5\times 10^{14} M^{-1}$, at least $10^{15} M^{-1}$ or at least $5\times 10^{15} M^{-1}$.

Besides the aforementioned modulator characteristics antibodies of the instant invention may further be characterized using additional physical characteristics including, for example, thermal stability (i.e, melting temperature; Tm), and isoelectric points. (See, e.g., Bjellqvist et al., 1993, Electrophoresis 14:1023; Vermeer et al., 2000, Biophys. J. 78:394-404; Vermeer et al., 2000, Biophys. J. 79: 2150-2154 each of which is incorporated herein by reference).

V. Antibody Drug Conjugates and Drug-Linker Moieties

It will be appreciated that the DLL3 conjugates of the instant invention comprise a DLL3 cell binding agent covalently linked through a linker moiety to a PBD drug payload. As discussed herein the DLL3 conjugates of the instant invention may be used to provide any one of PBD 1, PBD 2, PBD 3, PBD 4 or PBD 5 at the target location (e.g., tumorigenic cells). This is advantageously achieved by the disclosed ADCs which direct the bound drug payload to the target site in a relatively unreactive, non-toxic state before releasing and activating the drug payload. This targeted release of the toxic payload is largely achieved through linkers incorporated in the drug-linker compounds DL 1-5 which are fabricated so as not to be cleaved and release the cytotoxic dimeric PBD until the ADC has reached the tumorigenic cell. This advantageously provides for relatively high levels of the active PBD drug at the tumor site while minimizing exposure of non-targeted cells and tissue.

1. Linker Compounds

More particularly the linkers incorporated into the disclosed ADCs are preferably stable extracellularly, prevent aggregation of ADC molecules and keep the ADC freely soluble in aqueous media and in a monomeric state. Before transport or delivery into a cell, the antibody-drug conjugate (ADC) is preferably stable and remains intact, i.e. the antibody remains linked to the drug moiety. While the linkers are stable outside the target cell they are designed to be cleaved at some efficacious rate inside the cell. Accordingly an effective linker will: (i) maintain the specific binding properties of the antibody; (ii) allow intracellular delivery of the conjugate or drug moiety; (iii) remain stable and intact, i.e. not cleaved, until the conjugate has been delivered or transported to its targeted site; and (iv) maintain a cytotoxic, cell-killing effect or a cytostatic effect of the PBD drug moiety. Stability of the ADC may be measured by standard analytical techniques such as mass spectroscopy, HPLC, and the separation/analysis technique LC/MS. Covalent attachment of the antibody and the drug moiety requires the linker to have two reactive functional groups, i.e. bivalency in a reactive sense. Bivalent linker reagents which are useful to attach two or more functional or biologically active moieties, such as peptides, nucleic acids, drugs, toxins, antibodies, haptens, and reporter groups are known, and methods have been described their resulting conjugates (Hermanson, G. T. (1996) Bioconjugate Techniques; Academic Press: New York, p 234-242).

To this end the DLL3 ADCs of the invention comprise linkers that are cleavable by a cleaving agent that is present in the intracellular environment (e.g., within a lysosome or endosome or caveolae). In the case of ADCs 1-5 the linker comprises a peptidyl linker that is cleaved by an intracellular peptidase or protease enzyme, including, but not limited to, a lysosomal or endosomal protease. In certain embodiments, the peptidyl linker is preferably at least two amino acids long or in other embodiments at least three amino acids long. Cleaving agents can include cathepsins B and D and plasmin, each of which is known to hydrolyze dipeptide drug derivatives resulting in the release of active drug inside target cells. In the disclosed drug-linker moieties DL1-DL5 the peptidyl linker cleavable by an intracellular protease is a valine-alanine dipeptide moiety. One advantage of using intracellular proteolytic release of the therapeutic agent is that the agent is typically attenuated when conjugated and the serum stabilities of the conjugates are typically high.

Besides the enzyme cleavable dipeptide unit, the disclosed linkers found in ADCs 1-5 (or DL1-DL5) each include a spacer unit, a binding moiety to connect the drug-linker to the cell binding agent and, at least in the case of DL4 and DL5, a self-immolative moiety that provides for the clean disconnect of the PBD drug upon cleavage of the linker. With regard to the self-immolative group both DL4 and DL5 incorporate the same moiety. To that end the self-immolative linker and the dipeptide together form the group —NH-Val-Ala-CO—NH-PABC—, which is illustrated below:

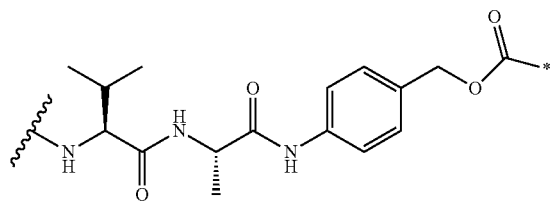 [SMILES: *N[C@H](C(=O)N[C@@H](C)C(=O)Nc1ccc(COC(*)=O)cc1)C(C)C]

where the asterisk indicates the point of attachment to the selected PBD cytotoxic moiety, and the wavy line indicates the point of attachment to the remaining portion of the linker (e.g., the spacer-antibody binding segments) which may be conjugated to the antibody. Upon enzymatic cleavage of the dipeptide the self-immolative linker will allow for clean release of the protected compound (i.e., the toxic PBD dimer) when a remote site is activated, proceeding along the lines shown below:

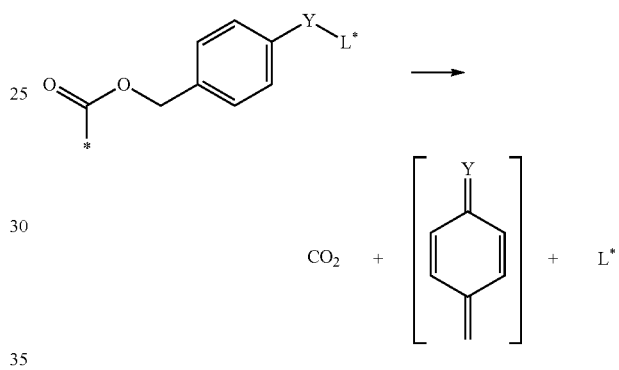

where L* is the activated form of the remaining portion of the linker comprising the now cleaved peptidyl unit. The clean release of PBD 4 and PBD 5 ensure they will maintain the desired toxic activity.

As will be discussed in more detail below and set forth in Example 7 the drug linkers of the instant invention will be linked to reactive thiol nucleophiles. Antibodies may be made reactive for conjugation with linker reagents by treatment with a reducing agent such as DTT (dithiothreitol). Each cysteine bridge will thus form, theoretically, two reactive thiol nucleophiles. U.S. Pat. No. 7,521,541 teaches engineering antibodies by introduction of reactive cysteine amino acids.

In DL 1, DL 2, DL 3 and DL 5 the connection between the cell binding agent and the drug-linker moiety is through a thiol residue of the cell binding agent and a terminal maleimide group of present on the linker. In such embodiments, the connection between the cell binding agent and the drug-linker is:

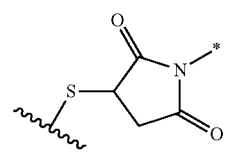 [SMILES: *SC1CC(=O)N(*)C1=O]

where the asterisk indicates the point of attachment to the remaining portion of drug-linker and the wavy line indicates the point of attachment to the remaining portion of the cell binding agent. In this embodiment, the S atom is typically derived from the DLL3 antibody.

With regard to DL4 the binding moiety comprises a terminal iodoacetamide that may be reacted with activated thiols to provide the desired ADC 4. As set forth in Example 7 below the preferred conjugation procedure for DL4 is slightly different from the preferred conjugation procedure for the maleimide binding group found in the other embodiments. In any event one skilled in the art could readily conjugate each of the disclosed drug-linker compounds with a compatible DLL3 modulator in view of the instant disclosure.

2. PBD Compounds

As discussed above and presented in the Examples below, each of the disclosed PBD compounds (depicted immediately below) exhibits cytotoxic properties that make it a potential candidate to be incorporated in the ADCs of the instant invention. The synthesis of each of PBD 1-5 as a component of each of DL 1-5 is presented in great detail in Example 1 below. In view of the instant disclosure the toxic compounds that comprise the payloads of the ADCs of the present invention could readily be generated and employed as set forth herein. The PBD compounds that are released from ADCs 1-5 upon cleavage of the linker are set forth immediately below:

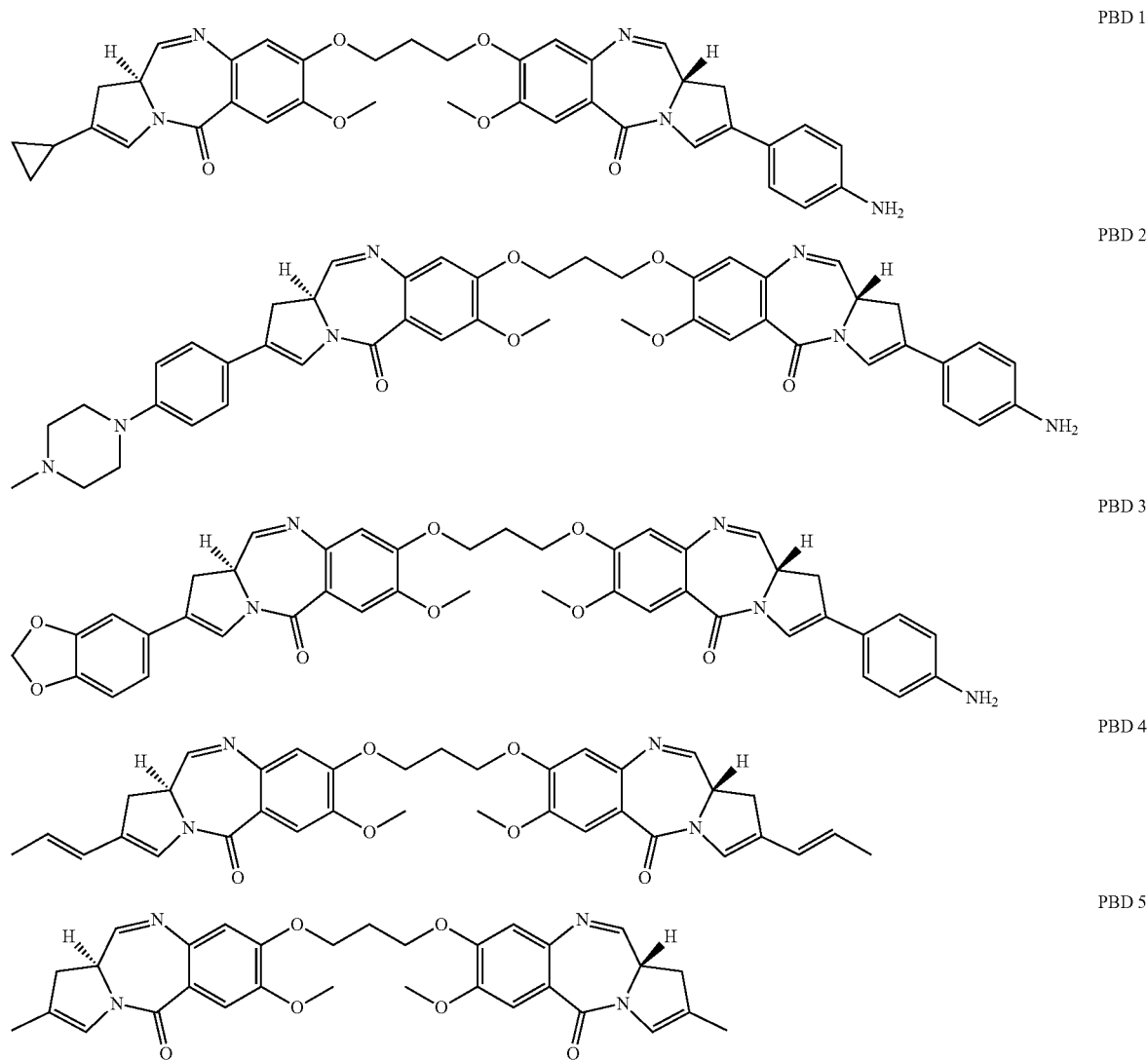

Delivery and release of such compounds at the tumor site(s) may prove clinically effective in treating or managing proliferative disorders in accordance with the instant disclosure. With regard to the compounds it will be appreciated that each of the disclosed PBDs have two $sp^2$ centres in each C-ring, which may allow for stronger binding in the minor groove of DNA (and hence greater toxicity), than for compounds with only one $sp^2$ centre in each C-ring. Thus, when used in DLL3 ADCs as set forth herein the disclosed PBDs may prove to be particularly effective for the treatment of proliferative disorders.

3. Drug-Linker Moieties

In accordance with the teachings herein the disclosed PBDs will be combined with linkers as set forth above to provide the drug-linker compounds, DL1-DL5, as set forth immediately below. Detailed protocols for the synthesis of each of the disclosed drug-linkers is set forth in Example 1 below.

DL1
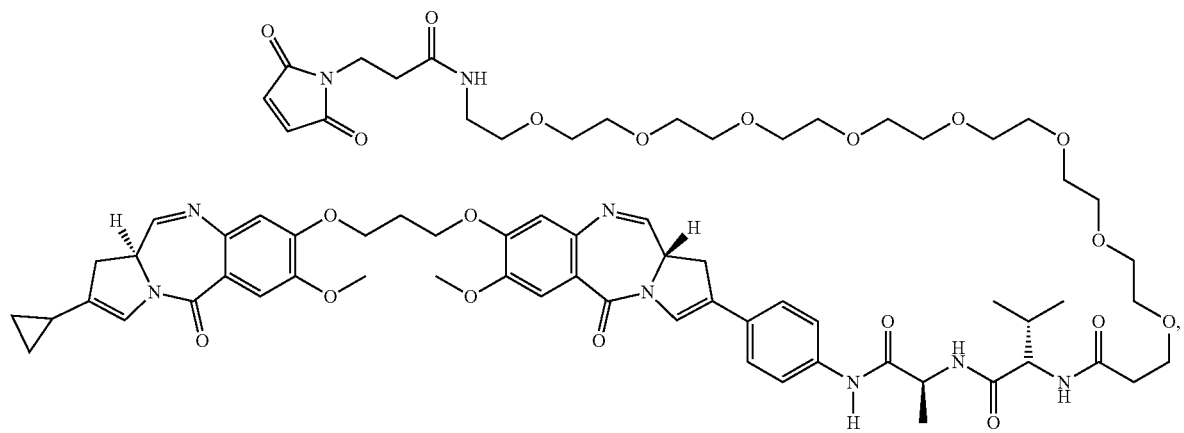
DL2
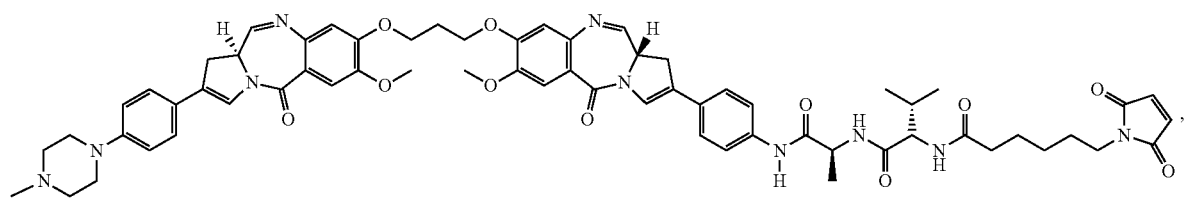
DL3
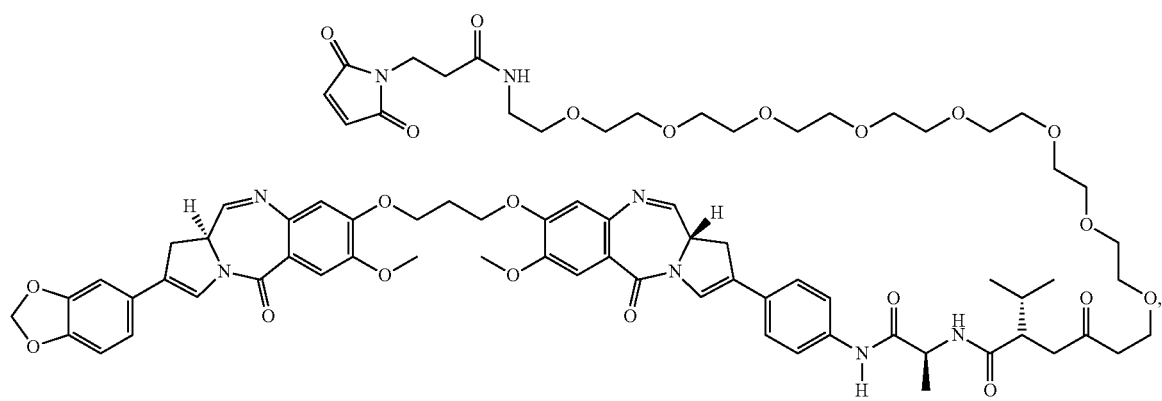
DL4
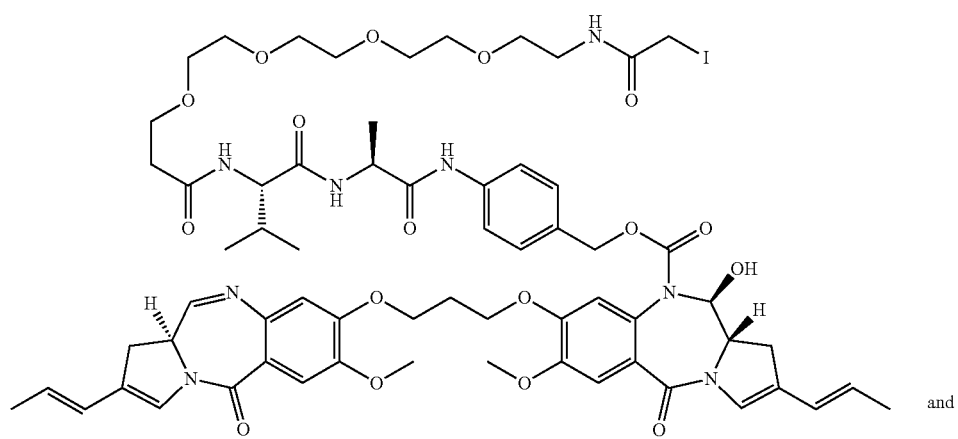
and

DL5

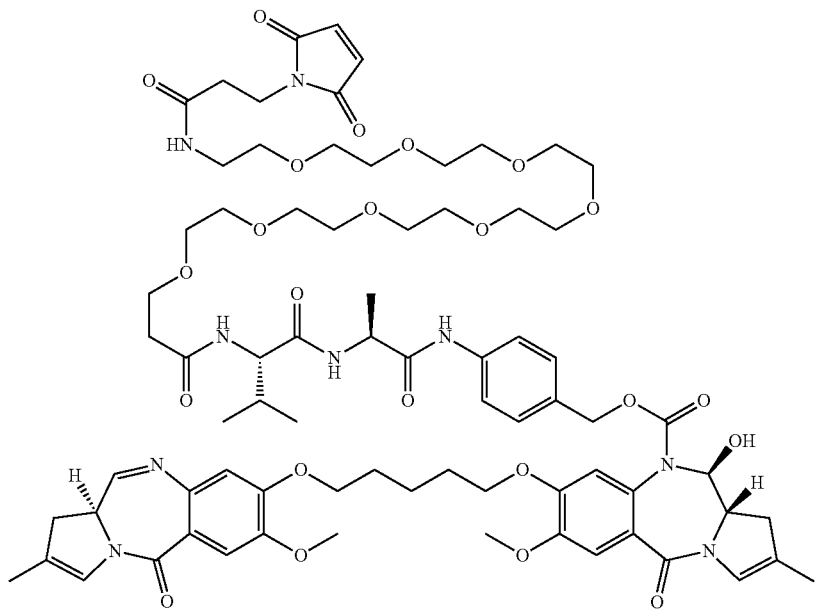

With regard to the drug-linkers DL 1-5 it will be appreciated that DL 1, DL 2, DL 3 and DL 5 each comprise a terminal maleimide group that may be used to conjugate the compounds with the selected DLL3 antibodies. Conversely, DL 4 comprises a terminal iodoacetamide group that is used to conjugate the PBD payload to the targeting antibody. It may be that, under certain conditions the use of an iodoacetamide moiety will avoid certain unwanted side reactions and provide enhanced ADC stability. Moreover, it will be appreciated that DL 4 and DL 5 comprise PBDs that are linked to the DLL3 modulator through the N10 position on the B ring while DL1, DL2 and DL3 are connected to the selected antibody through the C2 position on the C ring. With regard to the compounds that link through the N10 position it will further be noted the linkers comprise a PABC self-immolative moiety to ensure clean separation of the payload. In view of the instant teachings one of skill in the art could readily determine which DL (and associated ADC) would prove effective for the treatment of selected proliferative disorders.

4. Compound Characteristics

The following embodiments and variations set forth immediately below are applicable to the disclosed ADCs, drug linkers and/or PBDs and are expressly contemplated as being within the scope of the instant invention.

a. Solvates

It may be convenient or desirable to prepare, purify, and/or handle a corresponding solvate of the drug linker, ADC or PBD. The term "solvate" is used herein in the conventional sense to refer to a complex of solute (e.g. active compound, salt of active compound) and solvent. If the solvent is water, the solvate may be conveniently referred to as a hydrate, for example, a mono-hydrate, a di-hydrate, a tri-hydrate, etc.

The invention includes compounds where a solvent adds across the imine bond of the PBD moiety, which is illustrated below where the solvent is water or an alcohol ($R^4OH$, where $R^4$ is $C_{1-4}$ alkyl):

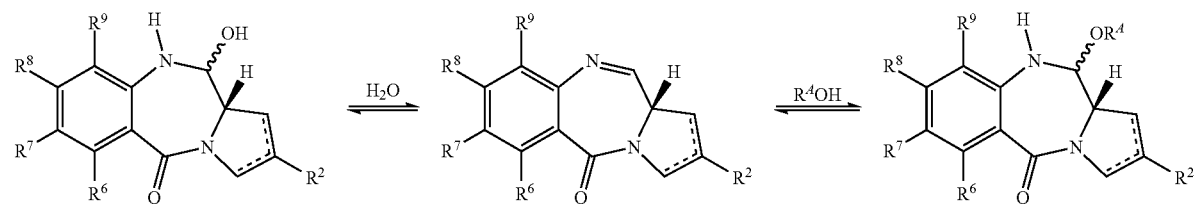

These forms can be called the carbinolamine and carbinolamine ether forms of the PBD (as described in the section relating to $R^{10}$ above). The balance of these equilibria depend on the conditions in which the compounds are found, as well as the nature of the moiety itself.

b. Isomers

Certain compounds of the invention may exist in one or more particular geometric, optical, enantiomeric, diastereomeric, epimeric, atropic, stereoisomeric, tautomeric, conformational, or anomeric forms, including but not limited to, cis- and trans-forms; E- and Z-forms; c-, t-, and r-forms; endo- and exo-forms; R-, S-, and meso-forms; D- and L-forms; d- and l-forms; (+) and (−) forms; keto-, enol-, and enolate-forms; syn- and anti-forms; synclinal- and anticlinal-forms; α- and β-forms; axial and equatorial forms; boat-, chair-, twist-, envelope-, and halfchair-forms; and combinations thereof, hereinafter collectively referred to as "isomers" (or "isomeric forms").

The term "chiral" refers to molecules which have the property of non-superimposability of the mirror image partner, while the term "achiral" refers to molecules which are superimposable on their mirror image partner.

The term "stereoisomers" refers to compounds which have identical chemical constitution, but differ with regard to the arrangement of the atoms or groups in space.

"Diastereomer" refers to a stereoisomer with two or more centers of chirality and whose molecules are not mirror images of one another. Diastereomers have different physical properties, e.g. melting points, boiling points, spectral properties, and reactivities. Mixtures of diastereomers may separate under high resolution analytical procedures such as electrophoresis and chromatography.

"Enantiomers" refer to two stereoisomers of a compound which are non-superimposable mirror images of one another.

Stereochemical definitions and conventions used herein generally follow S. P. Parker, Ed., *McGraw-Hill Dictionary of Chemical Terms* (1984) McGraw-Hill Book Company, New York; and Eliel, E. and Wilen, S., "Stereochemistry of Organic Compounds", John Wiley & Sons, Inc., New York, 1994. The compounds of the invention may contain asymmetric or chiral centers, and therefore exist in different stereoisomeric forms. It is intended that all stereoisomeric forms of the compounds of the invention, including but not limited to, diastereomers, enantiomers and atropisomers, as well as mixtures thereof such as racemic mixtures, form part of the present invention. Many organic compounds exist in optically active forms, i.e., they have the ability to rotate the plane of plane-polarized light. In describing an optically active compound, the prefixes D and L, or R and S, are used to denote the absolute configuration of the molecule about its chiral center(s). The prefixes d and l or (+) and (−) are employed to designate the sign of rotation of plane-polarized light by the compound, with (−) or l meaning that the compound is levorotatory. A compound prefixed with (+) or d is dextrorotatory. For a given chemical structure, these stereoisomers are identical except that they are mirror images of one another. A specific stereoisomer may also be referred to as an enantiomer, and a mixture of such isomers is often called an enantiomeric mixture. A 50:50 mixture of enantiomers is referred to as a racemic mixture or a racemate, which may occur where there has been no stereoselection or stereospecificity in a chemical reaction or process. The terms "racemic mixture" and "racemate" refer to an equimolar mixture of two enantiomeric species, devoid of optical activity.

Note that, except as discussed below for tautomeric forms, specifically excluded from the term "isomers", as used herein, are structural (or constitutional) isomers (i.e. isomers which differ in the connections between atoms rather than merely by the position of atoms in space). For example, a reference to a methoxy group, —OCH$_3$, is not to be construed as a reference to its structural isomer, a hydroxymethyl group, —CH$_2$OH. Similarly, a reference to ortho-chlorophenyl is not to be construed as a reference to its structural isomer, meta-chlorophenyl. However, a reference to a class of structures may well include structurally isomeric forms falling within that class (e.g. C$_{1-7}$ alkyl includes n-propyl and iso-propyl; butyl includes n-, iso-, sec-, and tert-butyl; methoxyphenyl includes ortho-, meta-, and para-methoxyphenyl).

The above exclusion does not pertain to tautomeric forms, for example, keto-, enol-, and enolate-forms, as in, for example, the following tautomeric pairs: keto/enol (illustrated below), imine/enamine, amide/imino alcohol, amidine/amidine, nitroso/oxime, thioketone/enethiol, N-nitroso/hyroxyazo, and nitro/aci-nitro.

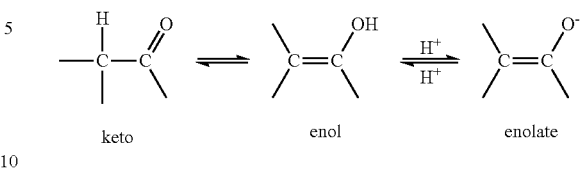

keto          enol          enolate

The term "tautomer" or "tautomeric form" refers to structural isomers of different energies which are interconvertible via a low energy barrier. For example, proton tautomers (also known as prototropic tautomers) include interconversions via migration of a proton, such as keto-enol and imine-enamine isomerizations. Valence tautomers include interconversions by reorganization of some of the bonding electrons.

Note that specifically included in the term "isomer" are compounds with one or more isotopic substitutions. For example, H may be in any isotopic form, including $^1$H, $^2$H (D), and $^3$H (T); C may be in any isotopic form, including $^{12}$C, $^{13}$C, and $^{14}$C; O may be in any isotopic form, including $^{16}$O and $^{18}$O; and the like.

Examples of isotopes that can be incorporated into compounds of the invention include isotopes of hydrogen, carbon, nitrogen, oxygen, phosphorous, fluorine, and chlorine, such as, but not limited to $^2$H (deuterium, D), $^3$H (tritium), $^{11}$C, $^{13}$C, $^{14}$C, $^{15}$N, $^{18}$F, $^{31}$P, $^{32}$P, $^{35}$S, $^{36}$Cl, and $^{125}$I. Various isotopically labeled compounds of the present invention, for example those into which radioactive isotopes such as 3H, 13C, and 14C are incorporated. Such isotopically labelled compounds may be useful in metabolic studies, reaction kinetic studies, detection or imaging techniques, such as positron emission tomography (PET) or single-photon emission computed tomography (SPECT) including drug or substrate tissue distribution assays, or in radioactive treatment of patients. Deuterium labelled or substituted therapeutic compounds of the invention may have improved DMPK (drug metabolism and pharmacokinetics) properties, relating to distribution, metabolism, and excretion (ADME). Substitution with heavier isotopes such as deuterium may afford certain therapeutic advantages resulting from greater metabolic stability, for example increased in vivo half-life or reduced dosage requirements. An 18F labeled compound may be useful for PET or SPECT studies. Isotopically labeled compounds of this invention and prodrugs thereof can generally be prepared by carrying out the procedures disclosed in the schemes or in the examples and preparations described below by substituting a readily available isotopically labeled reagent for a non-isotopically labeled reagent. Further, substitution with heavier isotopes, particularly deuterium (i.e., 2H or D) may afford certain therapeutic advantages resulting from greater metabolic stability, for example increased in vivo half-life or reduced dosage requirements or an improvement in therapeutic index. It is understood that deuterium in this context is regarded as a substituent. The concentration of such a heavier isotope, specifically deuterium, may be defined by an isotopic enrichment factor. In the compounds of this invention any atom not specifically designated as a particular isotope is meant to represent any stable isotope of that atom.

Unless otherwise specified, a reference to a particular compound includes all such isomeric forms, including (wholly or partially) racemic and other mixtures thereof. Methods for the preparation (e.g. asymmetric synthesis) and separation (e.g. fractional crystallization and chromatographic means) of such isomeric forms are either known in the art or are readily obtained by adapting the methods taught herein, or known methods, in a known manner.
5. Conjugates and Drug Loading
As discussed above the following antibody drug conjugates are provided by the insant invention:
ADC 1
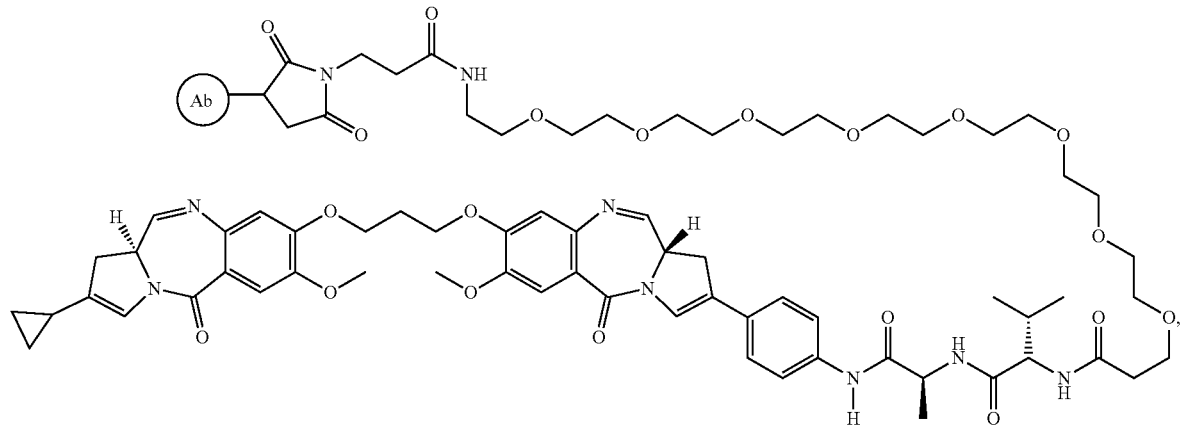
ADC 2
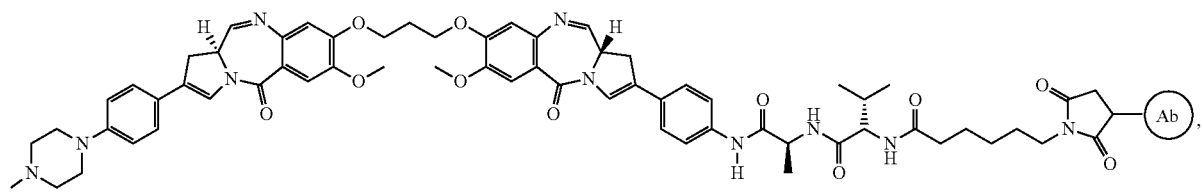
ADC 3
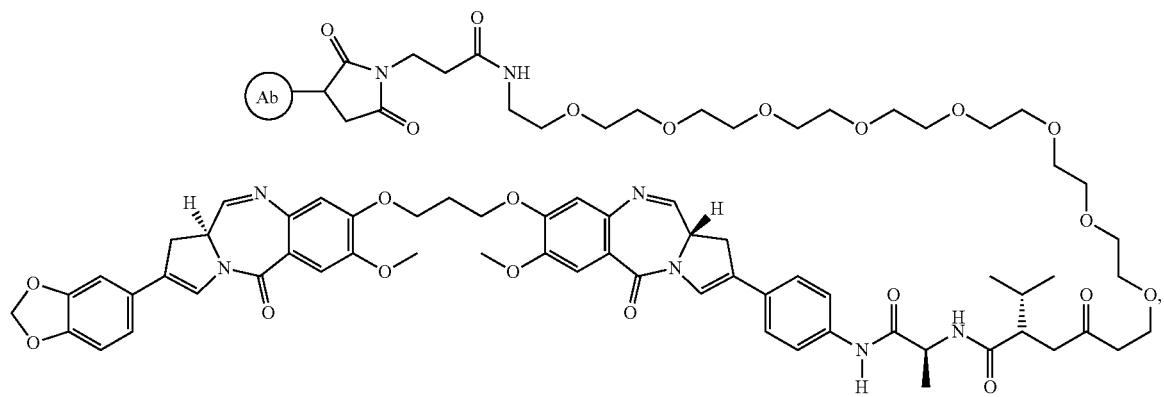
ADC 4
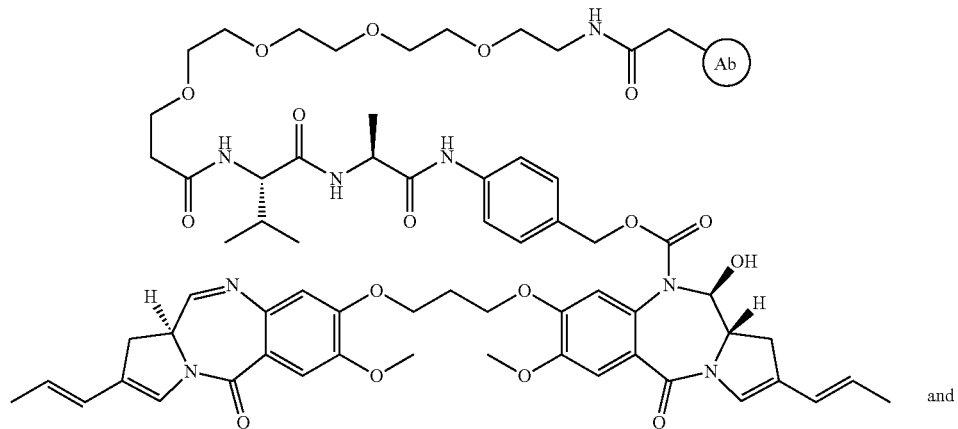
and

ADC5

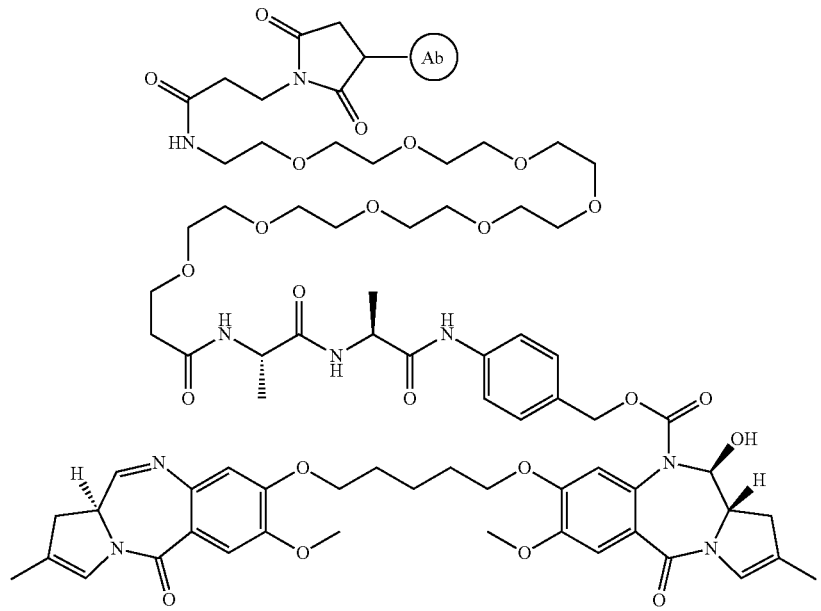

Once the modulators and drug-linkers of the invention have been generated and/or fabricated and selected according to the teachings herein they may be linked or conjugated to provide the disclosed ADCs. As used herein the terms "conjugate" or "modulator conjugate" or "antibody conjugate" or "DLL3 conjugate" or "ADC" or will be used interchangeably and held to mean any of ADC 1, ADC 2, ADC 3, ADC 4 or ADC 5. Art recognized techniques can be used to conjugate the selected antibody and the drug-linker to provide the desired ADC. Preferred conjugation methods are set forth in Example 7 below. Moreover, by varying the conjugation conditions as known in the art or selecting particular antibody constructs, ADCs exhibiting various stoichiometric molar ratios of drug to antibody may generated and are expressly within the scope of the instant invention.

More generally those skilled in the art will appreciate that a number of different reactions are available for the attachment or association of the disclosed drug-linkers to the DLL3 binding agents. By way of example nucleophilic groups on antibodies include, but are not limited to side chain thiol groups, e.g. cysteine. Thiol groups are nucleophilic and capable of reacting to form covalent bonds with electrophilic groups on linker moieties such as those of the present invention. Preferred antibodies of the instant invention will have reducible interchain disulfides, i.e. cysteine bridges providing such nucleophilic groups. Thus, in certain embodiments the reaction of free sulfhydryl groups of modulator cysteines and the terminal maleimido or iodoacetamide groups of the disclosed drug-linkers will provide the desired conjugation. In such cases antibodies may be made reactive for conjugation with linker reagents by treatment with a reducing agent such as dithiothreitol (DTT) or (tris (2-carboxyethyl)phosphine (TCEP). Each cysteine disulfide bridge will thus form, theoretically, two reactive thiol nucleophiles. In other embodiments additional nucleophilic groups can be introduced into antibodies through the reaction of lysines with reagents, including but not limited to, 2-iminothiolane (Traut's reagent), SATA, SATP or SAT (PEG)4, resulting in conversion of an amine into a thiol.

While such reagents are preferred it will be appreciated that conjugation of the disclosed drug-linkers and DLL3 modulators may be effected using various reactions, conditions and reagents known to those skilled in the art that provide for covalent bonding of a nucleophilic group of an antibody or cell binding agent with a drug-linker reagent. As indicated, particularly preferred methods are set forth in more detail in Example 7 below.

ADCs and ADC compositions of the invention may comprise drug and antibody moieties in various stoichiometric molar ratios depending, at least in part, on the method used to effect conjugation. As used herein the stoichiometric molar ratios are defined in terms of "Drug to Antibody Ratios," "DAR" or "drug loading." Put another way the drug loading or DAR is the weighted average number of PBD drugs per cell binding agent, e.g. an antibody in the composition. Where the PBD compounds of the invention are conjugated to naturally occurring cysteines in IgG1, drug loading may range from 1 to 8 drugs per cell binding agent, i.e. where 1, 2, 3, 4, 5, 6, 7, or 8 drug moieties are covalently attached to each cell binding agent. Preferably the DAR of compositions of the instant invention will be approximately 2, 4 or 6 and in particularly preferred embodiments the DAR will comprise approximately 2.

More specifically the conjugate compositions of the present invention comprise cell binding agents, e.g. antibodies, conjugated with a range of PBD compounds, from 1 to 8 (in the case of a IgG1). As such, the disclosed antibody drug conjugate compositions include mixtures of antibody drug conjugate compounds where most of the constituent antibodies are covalently linked to one or more PBD drug moieties and where the drug moieties may be attached to the antibody at various amino acid residues. That is, following conjugation ADC compositions of the invention will comprise a mixture of DLL3 conjugates with different drug loads (e.g., from 1 to 8 drugs per IgG1 antibody) at various concentrations. Using selective conjugation conditions and purification methods the conjugate compositions may be driven to the point where they largely contain a single predominant desired ADC species (e.g., with a drug loading of 2) with relatively low levels of other ADC species (e.g., with a drug loading of 1, 4, 6, etc.). The DAR value represents the weighted average of drug loading for the composition as a whole (i.e., all the ADC species taken together). Due to inherent uncertainty in the quantification methodology employed and the difficulty in completely removing the non-predominant ADC species in a commercial setting, acceptable DAR values or specifications are often presented as a range or distribution (i.e., a DAR of 2+/−0.5). Preferably compositions comprising a measured DAR within the range (i.e., 1.5 to 2.5) would be used in a pharmaceutical setting.

Thus, in certain preferred embodiments the present invention will comprise compositions having a DAR of 1, 2, 3, 4, 5, 6, 7 or 8 each +/−0.4. In other preferred embodiments the present invention will comprise a DAR of 2, 4, 6 or 8+/−0.4. Finally, in selected preferred embodiments the present invention will comprise a DAR of 2+/−0.4. It will be appreciated that the range or deviation may be less than 0.4 in certain preferred embodiments. Thus, in other embodiments the compositions will comprise a DAR of 1, 2, 3, 4, 5, 6, 7 or 8 each +/−0.3, a DAR of 2, 4, 6 or 8+/−0.3 or even more preferably a DAR of 2+/−0.3. In other embodiments IgG1 conjugate compositions will preferably comprise a composition with a DAR of 1, 2, 3, 4, 5, 6, 7 or 8 each +/−0.4 and relatively low levels (i.e., less than 30%) of non-predominant ADC species. In other preferred embodiments the ADC composition will comprise a DAR of 2, 4, 6 or 8 each +/−0.4 with relatively low levels (<30%) of non-predominant ADC species. In particularly preferred embodiments the ADC composition will comprise a DAR of 2+/−0.4 with relatively low levels (<30%) of non-predominant ADC species.

The distribution of drugs per antibody in preparations of ADC from conjugation reactions may be characterized by conventional means such as UV, reverse phase HPLC, HIC, mass spectroscopy, ELISA assay, and electrophoresis. The quantitative distribution of ADC in terms of drugs per antibody may also be determined. By ELISA, the averaged value of the drugs per antibody in a particular preparation of ADC may be determined (Hamblett et al (2004) Clin. Cancer Res. 10:7063-7070; Sanderson et al (2005) Clin. Cancer Res. 11:843-852). However, the distribution of drug per antibody values is not discernible by the antibody-antigen binding and detection limitation of ELISA. Also, ELISA assay for detection of antibody-drug conjugates does not determine where the drug moieties are attached to the antibody, such as the heavy chain or light chain fragments, or the particular amino acid residues. In some instances, separation, purification, and characterization of homogeneous ADC where the DAR comprises a certain well defined value from ADC with other drug loadings may be achieved by means such as reverse phase HPLC or electrophoresis. Such techniques are also applicable to other types of conjugates.

Where more than one nucleophilic or electrophilic group of the antibody reacts with a drug-linker intermediate, or linker reagent followed by drug moiety reagent, then the resulting product is a mixture of ADC compounds with a distribution of drug moieties attached to an antibody, e.g. 1, 2, 3, etc. Liquid chromatography methods such as polymeric reverse phase (PLRP) and hydrophobic interaction (HIC) may separate compounds in the mixture by drug loading value. Preparations of ADC with a single drug loading value may be isolated, however, these single loading value ADCs may still comprise heterogeneous mixtures because the drug moieties may be attached, via the linker, at different sites on the antibody.

For some antibody-drug conjugates, the number of drug loading may be limited by the number of attachment sites on the antibody. For example, an antibody may have only one or several cysteine thiol groups, or may have only one or several sufficiently reactive thiol groups through which a linker may be attached. Higher drug loading, e.g. >5, may cause aggregation, insolubility, toxicity, or loss of cellular permeability of certain antibody-drug conjugates.

Typically, fewer than the theoretical maximum of drug moieties are conjugated to an antibody during a conjugation reaction. An antibody may contain, for example, many lysine residues that do not react with the drug-linker intermediate or linker reagent. Only the most reactive lysine groups may react with an amine-reactive linker reagent. Also, only the most reactive cysteine thiol groups may react with a thiol-reactive linker reagent. Generally, antibodies do not contain many, if any, free and reactive cysteine thiol groups which may be linked to a drug moiety. Most cysteine thiol residues in the antibodies of the compounds exist as disulfide bridges and must be reduced with a reducing agent such as dithiothreitol (DTT) or TCEP, under partial or total reducing conditions. The loading (drug/antibody ratio) of an ADC may be controlled in several different manners, including: (i) limiting the molar excess of drug-linker intermediate or linker reagent relative to antibody, (ii) limiting the conjugation reaction time or temperature, and (iii) partial or limiting reductive conditions for cysteine thiol modification.

It will further be appreciated that reactive thiol groups may be introduced into the antibody (or fragment thereof) by engineering one, two, three, four, or more cysteine residues (e.g., preparing mutant antibodies comprising one or more non-native cysteine amino acid residues). That is, cysteine amino acids may be engineered at reactive sites in an antibody and which do not form intra-chain or intermolecular disulfide linkages (Junutula, et al., 2008b Nature Biotech., 26(8):925-932; Dornan et al (2009) Blood 114(13): 2721-2729; U.S. Pat. No. 7,521,541; U.S. Pat. No. 7,723, 485; WO2009/052249). The engineered cysteine thiols may react with linker reagents or the drug-linker reagents of the present invention which have thiol-reactive, electrophilic groups such as maleimide or alpha-iodo amides to form ADC with cysteine engineered antibodies and the PBD drug moieties. The location of the drug moiety can thus be designed, controlled, and known. The drug loading can be controlled since the engineered cysteine thiol groups typically react with thiol-reactive linker reagents or drug-linker reagents in high yield. Engineering an IgG antibody to introduce a cysteine amino acid by substitution at a single site on the heavy or light chain gives two new cysteines on the symmetrical antibody. A drug loading near 2 can be achieved with near homogeneity of the conjugation product ADC.

VI. Pharmaceutical Preparations and Therapeutic Uses

1. Formulations and Routes of Administration

Depending on the form of the selected conjugate, the mode of intended delivery, the disease being treated or monitored and numerous other variables, compositions of the invention may be formulated as desired using art-recognized techniques. In some embodiments, the therapeutic compositions of the invention may be administered neat or with a minimum of additional components while others may optionally be formulated to contain suitable pharmaceutically acceptable carriers comprising excipients and auxiliaries that are well known in the art (see, e.g., Gennaro, *Remington: The Science and Practice of Pharmacy with Facts and Comparisons: Drugfacts Plus*, 20th ed. (2003); Ansel et al., *Pharmaceutical Dosage Forms and Drug Delivery Systems*, 7$^{th}$ ed., Lippencott Williams and Wilkins (2004); Kibbe et al., *Handbook of Pharmaceutical Excipients*, 3$^{rd}$ ed., Pharmaceutical Press (2000)). Various pharmaceutically acceptable carriers, which include vehicles, adjuvants, and diluents, are readily available from numerous commercial sources. Moreover, an assortment of pharmaceutically acceptable auxiliary substances, such as pH adjusting and buffering agents, tonicity adjusting agents, stabilizers, wetting agents and the like, are also available. Certain non-limiting exemplary carriers include saline, buffered saline, dextrose, water, glycerol, ethanol, and combinations thereof.

More particularly it will be appreciated that, in some embodiments, the therapeutic compositions of the invention may be administered neat or with a minimum of additional components. Conversely the DLL3 ADCs of the present invention may optionally be formulated to contain suitable pharmaceutically acceptable carriers comprising excipients and auxiliaries that are well known in the art and are relatively inert substances that facilitate administration of the conjugate or which aid processing of the active compounds into preparations that are pharmaceutically optimized for delivery to the site of action. For example, an excipient can give form or consistency or act as a diluent to improve the pharmacokinetics or stability of the ADC. Suitable excipients or additives include, but are not limited to, stabilizing agents, wetting and emulsifying agents, salts for varying osmolarity, encapsulating agents, buffers, and skin penetration enhancers. In certain preferred embodiments the pharmaceutical compositions may be provided in a lyophilized form and reconstituted in, for example, buffered saline prior to administration. Such reconstituted compositions are preferably administered intravenously.

Disclosed ADCs for systemic administration may be formulated for enteral, parenteral or topical administration. Indeed, all three types of formulation may be used simultaneously to achieve systemic administration of the active ingredient. Excipients as well as formulations for parenteral and nonparenteral drug delivery are set forth in Remington, The Science and Practice of Pharmacy 20th Ed. Mack Publishing (2000). Suitable formulations for parenteral administration include aqueous solutions of the active compounds in water-soluble form, for example, water-soluble salts. In addition, suspensions of the active compounds as appropriate for oily injection suspensions may be administered. Suitable lipophilic solvents or vehicles include fatty oils, for example, hexylsubstituted poly(lactide), sesame oil, or synthetic fatty acid esters, for example, ethyl oleate or triglycerides. Aqueous injection suspensions may contain substances that increase the viscosity of the suspension and include, for example, sodium carboxymethyl cellulose, sorbitol, and/or dextran. Optionally, the suspension may also contain stabilizers. Liposomes can also be used to encapsulate the agent for delivery into the cell.

Suitable formulations for enteral administration include hard or soft gelatin capsules, pills, tablets, including coated tablets, elixirs, suspensions, syrups or inhalations and controlled release forms thereof.

Formulations suitable for parenteral administration (e.g., by injection), include aqueous or non-aqueous, isotonic, pyrogen-free, sterile liquids (e.g., solutions, suspensions), in which the active ingredient is dissolved, suspended, or otherwise provided (e.g., in a liposome or other microparticulate). Such liquids may additional contain other pharmaceutically acceptable ingredients, such as anti-oxidants, buffers, preservatives, stabilisers, bacteriostats, suspending agents, thickening agents, and solutes which render the formulation isotonic with the blood (or other relevant bodily fluid) of the intended recipient. Examples of excipients include, for example, water, alcohols, polyols, glycerol, vegetable oils, and the like. Examples of suitable isotonic carriers for use in such formulations include Sodium Chloride Injection, Ringer's Solution, or Lactated Ringer's Injection.

Compatible formulations for parenteral administration (e.g., intravenous injection) will comprise ADC concentrations of from about 10 µg/ml to about 100 mg/ml. In certain selected embodiments ADC concentrations will comprise 20 µg/ml, 40 µg/ml, 60 µg/ml, 80 µg/ml, 100 µg/ml, 200 µg/ml, 300, µg/ml, 400 µg/ml, 500 µg/ml, 600 µg/ml, 700 µg/ml, 800 µg/ml, 900 µg/ml or 1 mg/ml. In other preferred embodiments ADC concentrations will comprise 2 mg/ml, 3 mg/ml, 4 mg/ml, 5 mg/ml, 6 mg/ml, 8 mg/ml, 10 mg/ml, 12 mg/ml, 14 mg/ml, 16 mg/ml, 18 mg/ml, 20 mg/ml, 25 mg/ml, 30 mg/ml, 35 mg/ml, 40 mg/ml, 45 mg/ml, 50 mg/ml, 60 mg/ml, 70 mg/ml, 80 mg/ml, 90 mg/ml or 100 mg/ml.

In general the compounds and compositions of the invention, comprising DLL3 ADCs may be administered in vivo, to a subject in need thereof, by various routes, including, but not limited to, oral, intravenous, intra-arterial, subcutaneous, parenteral, intranasal, intramuscular, intracranial, intracardiac, intraventricular, intratracheal, buccal, rectal, intraperitoneal, intradermal, topical, transdermal, and intrathecal, or otherwise by implantation or inhalation. The subject compositions may be formulated into preparations in solid, semi-solid, liquid, or gaseous forms; including, but not limited to, tablets, capsules, powders, granules, ointments, solutions, suppositories, enemas, injections, inhalants, and aerosols. The appropriate formulation and route of administration may be selected according to the intended application and therapeutic regimen. In particularly preferred embodiments the compounds of the instant invention will be delivered intravenously.

2. Dosages

Similarly, the particular dosage regimen, i.e., dose, timing and repetition, will depend on the particular individual and that individual's medical history, as well as empirical considerations such as pharmacokinetics (e.g., half-life, clearance rate, etc.). Frequency of administration may be determined and adjusted over the course of therapy, and is based on reducing the number of proliferative or tumorigenic cells, maintaining the reduction of such neoplastic cells, reducing the proliferation of neoplastic cells, or delaying the development of metastasis. In other embodiments the dosage administered may be adjusted or attenuated to manage potential side effects and/or toxicity. Alternatively, sustained continuous release formulations of a subject therapeutic composition may be appropriate.

It will be appreciated by one of skill in the art that appropriate dosages of the conjugate compound, and compositions comprising the conjugate compound, can vary from patient to patient. Determining the optimal dosage will generally involve the balancing of the level of therapeutic benefit against any risk or deleterious side effects. The selected dosage level will depend on a variety of factors including, but not limited to, the activity of the particular compound, the route of administration, the time of administration, the rate of excretion of the compound, the duration of the treatment, other drugs, compounds, and/or materials used in combination, the severity of the condition, and the species, sex, age, weight, condition, general health, and prior medical history of the patient. The amount of compound and route of administration will ultimately be at the discretion of the physician, veterinarian, or clinician, although generally the dosage will be selected to achieve local concentrations at the site of action that achieve the desired effect without causing substantial harmful or deleterious side-effects.

In general, the ADCs of the invention may be administered in various ranges. These include about 5 µg/kg body weight to about 100 mg/kg body weight per dose; about 50 µg/kg body weight to about 5 mg/kg body weight per dose; about 100 µg/kg body weight to about 10 mg/kg body weight per dose. Other ranges include about 100 µg/kg body weight to about 20 mg/kg body weight per dose and about 0.5 mg/kg body weight to about 20 mg/kg body weight per dose. In certain embodiments, the dosage is at least about 100 µg/kg body weight, at least about 250 µg/kg body weight, at least about 750 µg/kg body weight, at least about 3 mg/kg body weight, at least about 5 mg/kg body weight, at least about 10 mg/kg body weight.

In selected embodiments the ADCs will be administered (preferably intravenously) at approximately 10, 20, 30, 40, 50, 60, 70, 80, 90 or 100 µg/kg body weight per dose. Other embodiments will comprise the administration of ADCs at about 200, 300, 400, 500, 600, 700, 800, 900, 1000, 1100, 1200, 1300, 1400, 1500, 1600, 1700, 1800, 1900 or 2000 µg/kg body weight per dose. In other preferred embodiments the disclosed conjugates will be administered at 2.5, 3, 3.5, 4, 4.5, 5, 5.5, 6, 6.5, 7, 7.58, 9 or 10 mg/kg. In still other embodiments the conjugates may be administered at 12, 14, 16, 18 or 20 mg/kg body weight per dose. In yet other embodiments the conjugates may be administered at 25, 30, 35, 40, 45, 50, 55, 60, 65, 70, 75, 80, 90 or 100 mg/kg body weight per dose. With the teachings herein one of skill in the art could readily determine appropriate dosages for various ADCs based on preclinical animal studies, clinical observations and standard medical and biochemical techniques and measurements. In particularly preferred embodiments such DLL3 conjugate dosages will be administered intravenously over a period of time. Moreover, such dosages may be administered multiple times over a defined course of treatment.

Other dosing regimens may be predicated on Body Surface Area (BSA) calculations as disclosed in U.S. Pat. No. 7,744,877. As is well known, the BSA is calculated using the patient's height and weight and provides a measure of a subject's size as represented by the surface area of his or her body. In certain embodiments, the conjugates may be administered in dosages from 1 mg/m$^2$ to 800 mg/m$^2$, from 50 mg/m$^2$ to 500 mg/m$^2$ and at dosages of 100 mg/m$^2$, 150 mg/m$^2$, 200 mg/m$^2$, 250 mg/m$^2$, 300 mg/m$^2$, 350 mg/m$^2$, 400 mg/m$^2$ or 450 mg/m$^2$. It will also be appreciated that art recognized and empirical techniques may be used to determine appropriate dosage.

In any event, DLL3 ADCs are preferably administered as needed to subjects in need thereof. Determination of the frequency of administration may be made by persons skilled in the art, such as an attending physician based on considerations of the condition being treated, age of the subject being treated, severity of the condition being treated, general state of health of the subject being treated and the like. Generally, an effective dose of the DLL3 conjugate is administered to a subject one or more times. More particularly, an effective dose of the ADC is administered to the subject once a month, more than once a month, or less than once a month. In certain embodiments, the effective dose of the DLL3 ADC may be administered multiple times, including for periods of at least a month, at least six months, at least a year, at least two years or a period of several years. In yet other embodiments, several days (2, 3, 4, 5, 6 or 7), several weeks (1, 2, 3, 4, 5, 6, 7 or 8) or several months (1, 2, 3, 4, 5, 6, 7 or 8) or even a year or several years may lapse between administration of the disclosed modulators.

In certain preferred embodiments the course of treatment involving conjugated modulators will comprise multiple doses of the selected drug product over a period of weeks or months. More specifically, conjugated modulators of the instant invention may administered once every day, every two days, every four days, every week, every ten days, every two weeks, every three weeks, every month, every six weeks, every two months, every ten weeks or every three months. In this regard it will be appreciated that the dosages may be altered or the interval may be adjusted based on patient response and clinical practices.

Dosages and regimens may also be determined empirically for the disclosed therapeutic compositions in individuals who have been given one or more administration(s). For example, individuals may be given incremental dosages of a therapeutic composition produced as described herein. In selected embodiments the dosage may be gradually increased or reduced or attenuated based respectively on empirically determined or observed side effects or toxicity. To assess efficacy of the selected composition, a marker of the specific disease, disorder or condition can be followed as described previously. For cancer, these include direct measurements of tumor size via palpation or visual observation, indirect measurement of tumor size by x-ray or other imaging techniques; an improvement as assessed by direct tumor biopsy and microscopic examination of the tumor sample; the measurement of an indirect tumor marker (e.g., PSA for prostate cancer) or a tumorigenic antigen identified according to the methods described herein, a decrease in pain or paralysis; improved speech, vision, breathing or other disability associated with the tumor; increased appetite; or an increase in quality of life as measured by accepted tests or prolongation of survival. It will be apparent to one of skill in the art that the dosage will vary depending on the individual, the type of neoplastic condition, the stage of neoplastic condition, whether the neoplastic condition has begun to metastasize to other location in the individual, and the past and concurrent treatments being used.

3. Combination Therapies

In accordance with the instant invention combination therapies may be particularly useful in decreasing or inhibiting unwanted neoplastic cell proliferation, decreasing the occurrence of cancer, decreasing or preventing the recurrence of cancer, or decreasing or preventing the spread or metastasis of cancer. In such cases the ADCs of the instant invention may function as sensitizing or chemosensitizing agents by removing the CSCs that would otherwise prop up and perpetuate the tumor mass and thereby allow for more effective use of current standard of care debulking or anti-cancer agents. That is, the disclosed ADCs may, in certain embodiments provide an enhanced effect (e.g., additive or synergistic in nature) that potentiates the mode of action of another administered therapeutic agent. In the context of the instant invention "combination therapy" shall be interpreted broadly and merely refers to the administration of a DLL3 ADC and one or more anti-cancer agents that include, but are not limited to, cytotoxic agents, cytostatic agents, anti-angiogenic agents, debulking agents, chemotherapeutic agents, radiotherapy and radiotherapeutic agents, targeted anti-cancer agents (including both monoclonal antibodies and small molecule entities), BRMs, therapeutic antibodies, cancer vaccines, cytokines, hormone therapies, radiation therapy and anti-metastatic agents and immunotherapeutic agents, including both specific and non-specific approaches.

There is no requirement for the combined results to be additive of the effects observed when each treatment (e.g., ADC and anti-cancer agent) is conducted separately. Although at least additive effects are generally desirable, any increased anti-tumor effect above one of the single therapies is beneficial. Furthermore, the invention does not require the combined treatment to exhibit synergistic effects. However, those skilled in the art will appreciate that with certain selected combinations that comprise preferred embodiments, synergism may be observed.

In practicing combination therapy, the DLL3 conjugate and anti-cancer agent may be administered to the subject simultaneously, either in a single composition, or as two or more distinct compositions using the same or different administration routes. Alternatively, the ADC may precede, or follow, the anti-cancer agent treatment by, e.g., intervals ranging from minutes to weeks. The time period between each delivery is such that the anti-cancer agent and conjugate are able to exert a combined effect on the tumor. In at least one embodiment, both the anti-cancer agent and the ADC are administered within about 5 minutes to about two weeks of each other. In yet other embodiments, several days (2, 3, 4, 5, 6 or 7), several weeks (1, 2, 3, 4, 5, 6, 7 or 8) or several months (1, 2, 3, 4, 5, 6, 7 or 8) may lapse between administration of the DLL3 ADC and the anti-cancer agent.

The combination therapy may be administered once, twice or at least for a period of time until the condition is treated, palliated or cured. In some embodiments, the combination therapy is administered multiple times, for example, from three times daily to once every six months. The administering may be on a schedule such as three times daily, twice daily, once daily, once every two days, once every three days, once weekly, once every two weeks, once every month, once every two months, once every three months, once every six months or may be administered continuously via a minipump. The combination therapy may be administered via any route, as noted previously. The combination therapy may be administered at a site distant from the site of the tumor.

In one embodiment a ADC is administered in combination with one or more anti-cancer agents for a short treatment cycle to a subject in need thereof. The invention also contemplates discontinuous administration or daily doses divided into several partial administrations. The conjugate and anti-cancer agent may be administered interchangeably, on alternate days or weeks; or a sequence of antibody treatments may be given, followed by one or more treatments of anti-cancer agent therapy. In any event, as will be understood by those of ordinary skill in the art, the appropriate doses of chemotherapeutic agents and the disclosed conjugates will be generally around those already employed in clinical therapies wherein the chemotherapeutics are administered alone or in combination with other chemotherapeutics.

In another preferred embodiment the DLL3 conjugates of the instant invention may be used in maintenance therapy to reduce or eliminate the chance of tumor recurrence following the initial presentation of the disease. Preferably the disorder will have been treated and the initial tumor mass eliminated, reduced or otherwise ameliorated so the patient is asymptomatic or in remission. At such time the subject may be administered pharmaceutically effective amounts of the disclosed DLL3 conjugates one or more times even though there is little or no indication of disease using standard diagnostic procedures. In some embodiments, the ADCs will be administered on a regular schedule over a period of time, such as weekly, every two weeks, monthly, every six weeks, every two months, every three months every six months or annually. Given the teachings herein, one skilled in the art could readily determine favorable dosages and dosing regimens to reduce the potential of disease recurrence. Moreover such treatments could be continued for a period of weeks, months, years or even indefinitely depending on the patient response and clinical and diagnostic parameters.

In yet another preferred embodiment the ADCs of the present invention may be used to prophylactically or as an adjuvant therapy to prevent or reduce the possibility of tumor metastasis following a debulking procedure. As used in the instant disclosure a "debulking procedure" is defined broadly and shall mean any procedure, technique or method that eliminates, reduces, treats or ameliorates a tumor or tumor proliferation. Exemplary debulking procedures include, but are not limited to, surgery, radiation treatments (i.e., beam radiation), chemotherapy, immunotherapy or ablation. At appropriate times readily determined by one skilled in the art in view of the instant disclosure the disclosed ADCs may be administered as suggested by clinical, diagnostic or theragnostic procedures to reduce tumor metastasis. The conjugates may be administered one or more times at pharmaceutically effective dosages as determined using standard techniques. Preferably the dosing regimen will be accompanied by appropriate diagnostic or monitoring techniques that allow it to be modified.

Yet other embodiments of the invention comprise administering the disclosed DLL3 conjugates to subjects that are asymptomatic but at risk of developing a proliferative disorder. That is, the conjugates of the instant invention may be used in a truly preventative sense and given to patients that have been examined or tested and have one or more noted risk factors (e.g., genomic indications, family history, in vivo or in vitro test results, etc.) but have not developed neoplasia. In such cases those skilled in the art would be able to determine an effective dosing regimen through empirical observation or through accepted clinical practices.

4. Anti-Cancer Agents

As discussed throughout the instant application the DLL3 conjugates of the instant invention may be used in combination with anti-cancer agents. The term "anti-cancer agent" or "anti-proliferative agent" means any agent that can be used to treat a cell proliferative disorder such as cancer, and includes, but is not limited to, cytotoxic agents, cytostatic agents, anti-angiogenic agents, debulking agents, chemotherapeutic agents, radiotherapy and radiotherapeutic agents, targeted anti-cancer agents, BRMs, therapeutic antibodies, cancer vaccines, cytokines, hormone therapies, radiation therapy and anti-metastatic agents and immunotherapeutic agents.

As used herein the term "cytotoxic agent" means a substance that is toxic to the cells and decreases or inhibits the function of cells and/or causes destruction of cells. In certain embodiments the substance is a naturally occurring molecule derived from a living organism. Examples of cytotoxic agents include, but are not limited to, small molecule toxins or enzymatically active toxins of bacteria (e.g., Diptheria toxin, *Pseudomonas* endotoxin and exotoxin, Staphylococcal enterotoxin A), fungal (e.g., α-sarcin, restrictocin), plants (e.g., abrin, ricin, modeccin, viscumin, pokeweed anti-viral protein, saporin, gelonin, momoridin, trichosanthin, barley toxin, *Aleurites fordii* proteins, dianthin proteins, *Phytolacca mericana* proteins (PAPI, PAPII, and PAP-S), *Momordica charantia* inhibitor, curcin, crotin, *saponaria officinalis* inhibitor, gelonin, mitegellin, restrictocin, phenomycin, neomycin, and the tricothecenes) or animals, (e.g., cytotoxic RNases, such as extracellular pancreatic RNases; DNase I, including fragments and/or variants thereof).

For the purposes of the instant invention a "chemotherapeutic agent" comprises a chemical compound that nonspecifically decreases or inhibits the growth, proliferation, and/or survival of cancer cells (e.g., cytotoxic or cytostatic agents). Such chemical agents are often directed to intracellular processes necessary for cell growth or division, and are thus particularly effective against cancerous cells, which generally grow and divide rapidly. For example, vincristine depolymerizes microtubules, and thus inhibits cells from entering mitosis. In general, chemotherapeutic agents can include any chemical agent that inhibits, or is designed to inhibit, a cancerous cell or a cell likely to become cancerous or generate tumorigenic progeny (e.g., TIC). Such agents are often administered, and are often most effective, in combination, e.g., in regimens such as CHOP or FOLFIRI.

Examples of anti-cancer agents that may be used in combination with the DLL3 ADCs of the present invention include, but are not limited to, alkylating agents, alkyl sulfonates, aziridines, ethylenimines and methylamelamines, acetogenins, a camptothecin, bryostatin, callystatin, CC-1065, cryptophycins, dolastatin, duocarmycin, eleutherobin, pancratistatin, a sarcodictyin, spongistatin, nitrogen mustards, antibiotics, enediyne antibiotics, dynemicin, bisphosphonates, esperamicin, chromoprotein enediyne antiobiotic chromophores, aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, ADRIAMYCIN® doxorubicin, epirubicin, esorubicin, idarubicin, marcellomycin, mitomycins, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites, erlotinib, vemurafenib, crizotinib, sorafenib, ibrutinib, enzalutamide, folic acid analogues, purine analogs, androgens, anti-adrenals, folic acid replenisher such as frolinic acid, aceglatone, aldophosphamide glycoside, aminolevulinic acid, eniluracil, amsacrine, bestrabucil, bisantrene, edatraxate, defofamine, demecolcine, diaziquone, elfornithine, elliptinium acetate, an epothilone, etoglucid, gallium nitrate, hydroxyurea, lentinan, lonidainine, maytansinoids, mitoguazone, mitoxantrone, mopidanmol, nitraerine, pentostatin, phenamet, pirarubicin, losoxantrone, podophyllinic acid, 2-ethylhydrazide, procarbazine, PSK® polysaccharide complex (JHS Natural Products, Eugene, Oreg.), razoxane; rhizoxin; sizofiran; spirogermanium; tenuazonic acid; triaziquone; 2,2',2"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, chloranbucil; GEMZAR® gemcitabine; 6-thioguanine; mercaptopurine; methotrexate; platinum analogs, vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; irinotecan (Camptosar, CPT-11), topoisomerase inhibitor RFS 2000; difluorometlhylomithine; retinoids; capecitabine; combretastatin; leucovorin; oxaliplatin; inhibitors of PKC-alpha, Raf, H-Ras, EGFR and VEGF-A that reduce cell proliferation and pharmaceutically acceptable salts, acids or derivatives of any of the above. Also included in this definition are anti-hormonal agents that act to regulate or inhibit hormone action on tumors such as anti-estrogens and selective estrogen receptor modulators, aromatase inhibitors that inhibit the enzyme aromatase, which regulates estrogen production in the adrenal glands, and anti-androgens; as well as troxacitabine (a 1,3-dioxolane nucleoside cytosine analog); antisense oligonucleotides, ribozymes such as a VEGF expression inhibitor and a HER2 expression inhibitor; vaccines, PROLEUKIN® rIL-2; LURTOTECAN® topoisomerase 1 inhibitor; ABARELIX® rmRH; Vinorelbine and Esperamicins and pharmaceutically acceptable salts, acids or derivatives of any of the above.

Particularly preferred anti-cancer agents comprise commercially or clinically available compounds such as erlotinib (TARCEVA®, Genentech/OSI Pharm.), docetaxel (TAXOTERE®, Sanofi-Aventis), 5-FU (fluorouracil, 5-fluorouracil, CAS No. 51-21-8), gemcitabine (GEMZAR®, Lilly), PD-0325901 (CAS No. 391210-10-9, Pfizer), cisplatin (cis-diamine, dichloroplatinum(II), CAS No. 15663-27-1), carboplatin (CAS No. 41575-94-4), paclitaxel (TAXOL®, Bristol-Myers Squibb Oncology, Princeton, N.J.), trastuzumab (HERCEPTIN®, Genentech), temozolomide (4-methyl-5-oxo-2,3,4,6,8-pentazabicyclo[4.3.0]nona-2,7, 9-triene-9-carboxamide, CAS No. 85622-93-1, TEMODAR®, TEMODAL®, Schering Plough), tamoxifen ((Z)-2-[4-(1,2-diphenylbut-1-enyl)phenoxy]-N,N-dimethylethanamine, NOLVADEX®, ISTUBAL®, VALODEX®), and doxorubicin (ADRIAMYCIN®). Additional commercially or clinically available anti-cancer agents comprise oxaliplatin (ELOXATIN®, Sanofi), bortezomib (VELCADE®, Millennium Pharm.), sutent (SUNITINIB®, SU1 1248, Pfizer), letrozole (FEMARA®, Novartis), imatinib mesylate (GLEEVEC®, Novartis), XL-518 (Mek inhibitor, Exelixis, WO 2007/044515), ARRY-886 (Mek inhibitor, AZD6244, Array BioPharma, Astra Zeneca), SF-1126 (PI3K inhibitor, Semafore Pharmaceuticals), BEZ-235 (PI3K inhibitor, Novartis), XL-147 (PI3K inhibitor, Exelixis), PTK787/ZK 222584 (Novartis), fulvestrant (FASLODEX®, AstraZeneca), leucovorin (folinic acid), rapamycin (sirolimus, RAPAMUNE®, Wyeth), lapatinib (TYKERB®, GSK572016, Glaxo Smith Kline), lonafamib (SARASAR™, SCH 66336, Schering Plough), sorafenib (NEXAVAR®, BAY43-9006, Bayer Labs), gefitinib (IRESSA®, AstraZeneca), irinotecan (CAMPTOSAR®, CPT-11, Pfizer), tipifarnib (ZARNESTRA™, Johnson & Johnson), ABRAXANE™ (Cremophor-free), albumin-engineered nanoparticle formulations of paclitaxel (American Pharmaceutical Partners, Schaumberg, Ill.), vandetanib (rINN, ZD6474, ZACTIMA®, AstraZeneca), chloranmbucil, AG1478, AG1571 (SU 5271; Sugen), temsirolimus (TORISEL®, Wyeth), pazopanib (GlaxoSmithKline), canfosfamide (TELCYTA®, Telik), thiotepa and cyclosphosphamide (CYTOXAN®, NEOSAR®); vinorelbine (NAVELBINE®); capecitabine (XELODA®, Roche), tamoxifen (including NOLVADEX®; tamoxifen citrate, FARESTON® (toremifine citrate) MEGASE® (megestrol acetate), AROMASIN® (exemestane; Pfizer), formestanie, fadrozole, RIVISOR® (vorozole), FEMARA® (letrozole; Novartis), and ARIMIDEX® (anastrozole; AstraZeneca).

In other embodiments the DLL3 conjugates of the instant invention may be used in combination with any one of a number of antibodies (or immunotherapeutic agents) presently in clinical trials or commercially available. To this end the disclosed DLL3 conjugates may be used in combination with an antibody selected from the group consisting of abagovomab, adecatumumab, afutuzumab, alemtuzumab, altumomab, amatuximab, anatumomab, arcitumomab, bavituximab, bectumomab, bevacizumab, bivatuzumab, blinatumomab, brentuximab, cantuzumab, catumaxomab, cetuximab, citatuzumab, cixutumumab, clivatuzumab, conatumumab, daratumumab, drozitumab, duligotumab, dusigitumab, detumomab, dacetuzumab, dalotuzumab, ecromeximab, elotuzumab, ensituximab, ertumaxomab, etaracizumab, farletuzumab, ficlatuzumab, figitumumab, flanvotumab, futuximab, ganitumab, gemtuzumab, girentuximab, glembatumumab, ibritumomab, igovomab, imgatuzumab, indatuximab, inotuzumab, intetumumab, ipilimumab, iratumumab, labetuzumab, lexatumumab, lintuzumab, lorvotuzumab, lucatumumab, mapatumumab, matuzumab, milatuzumab, minretumomab, mitumomab, moxetumomab, narnatumab, naptumomab, necitumumab, nimotuzumab, nofetumomabn, ocaratuzumab, ofatumumab, olaratumab, onartuzumab, oportuzumab, oregovomab, panitumumab, parsatuzumab, patritumab, pemtumomab, pertuzumab, pintumomab, pritumumab, racotumomab, ramucirumab, radretumab, rilotumumab, rituximab, robatumumab, satumomab, sibrotuzumab, siltuximab, simtuzumab, solitomab, tacatuzumab, taplitumomab, tenatumomab, teprotumumab, tigatuzumab, tositumomab, trastuzumab, tucotuzumab, ublituximab, veltuzumab, vorsetuzumab, votumumab, zalutumumab, CC49, 3F8 and combinations thereof.

Still other particularly preferred embodiments will comprise the use of antibodies in testing or approved for cancer therapy including, but not limited to, rituximab, trastuzumab, gemtuzumab ozogamcin, alemtuzumab, ibritumomab tiuxetan, tositumomab, bevacizumab, cetuximab, panitumumab, ramucirumab, ofatumumab, ipilimumab and brentuximab vedotin. Those skilled in the art will be able to readily identify additional anti-cancer agents that are compatible with the teachings herein.

5. Radiotherapy

The present invention also provides for the combination of DLL3 conjugates with radiotherapy (i.e., any mechanism for inducing DNA damage locally within tumor cells such as gamma-irradiation, X-rays, UV-irradiation, microwaves, electronic emissions and the like). Combination therapy using the directed delivery of radioisotopes to tumor cells is also contemplated, and the disclosed conjugates may be used in connection with a targeted anti-cancer agent or other targeting means. Typically, radiation therapy is administered in pulses over a period of time from about 1 to about 2 weeks. The radiation therapy may be administered to subjects having head and neck cancer for about 6 to 7 weeks. Optionally, the radiation therapy may be administered as a single dose or as multiple, sequential doses.

VII. Indications

It will be appreciated that the ADCs of the instant invention may be used to treat, prevent, manage or inhibit the occurrence or recurrence of any DLL3 associated disorder. Accordingly, whether administered alone or in combination with an anti-cancer agent or radiotherapy, the ADCs of the invention are particularly useful for generally treating neoplastic conditions in patients or subjects which may include benign or malignant tumors (e.g., adrenal, liver, kidney, bladder, breast, gastric, ovarian, colorectal, prostate, pancreatic, lung, thyroid, hepatic, cervical, endometrial, esophageal and uterine carcinomas; sarcomas; glioblastomas; and various head and neck tumors); leukemias and lymphoid malignancies; other disorders such as neuronal, glial, astrocytal, hypothalamic and other glandular, macrophagal, epithelial, stromal and blastocoelic disorders; and inflammatory, angiogenic, immunologic disorders and disorders caused by pathogens. Particularly, key targets for treatment are neoplastic conditions comprising solid tumors, although hematologic malignancies are within the scope of the invention.

The term "treatment," as used herein in the context of treating a condition, pertains generally to treatment and therapy, whether of a human or an animal (e.g., in veterinary applications), in which some desired therapeutic effect is achieved, for example, the inhibition of the progress of the condition, and includes a reduction in the rate of progress, a halt in the rate of progress, regression of the condition, amelioration of the condition, and cure of the condition. Treatment as a prophylactic measure (i.e., prophylaxis, prevention) is also included.

The term "therapeutically-effective amount," as used herein, pertains to that amount of an active compound, or a material, composition or dosage from comprising an active compound, which is effective for producing some desired therapeutic effect, commensurate with a reasonable benefit/risk ratio, when administered in accordance with a desired treatment regimen.

Similarly, the term "prophylactically-effective amount," as used herein, pertains to that amount of an active compound, or a material, composition or dosage from comprising an active compound, which is effective for producing some desired prophylactic effect, commensurate with a reasonable benefit/risk ratio, when administered in accordance with a desired treatment regimen.

More specifically, neoplastic conditions subject to treatment in accordance with the instant invention may be selected from the group including, but not limited to, adrenal gland tumors, AIDS-associated cancers, alveolar soft part sarcoma, astrocytic tumors, bladder cancer (squamous cell carcinoma and transitional cell carcinoma), bone cancer (adamantinoma, aneurismal bone cysts, osteochondroma, osteosarcoma), brain and spinal cord cancers, metastatic brain tumors, breast cancer, carotid body tumors, cervical cancer, chondrosarcoma, chordoma, chromophobe renal cell carcinoma, clear cell carcinoma, colon cancer, colorectal cancer, cutaneous benign fibrous histiocytomas, desmoplastic small round cell tumors, ependymomas, Ewing's tumors, extraskeletal myxoid chondrosarcoma, fibrogenesis imperfecta ossium, fibrous dysplasia of the bone, gallbladder and bile duct cancers, gestational trophoblastic disease, germ cell tumors, head and neck cancers, islet cell tumors, Kaposi's Sarcoma, kidney cancer (nephroblastoma, papillary renal cell carcinoma), leukemias, lipoma/benign lipomatous tumors, liposarcoma/malignant lipomatous tumors, liver cancer (hepatoblastoma, hepatocellular carcinoma), lymphomas, lung cancers (small cell carcinoma, adenocarcinoma, squamous cell carcinoma, large cell carcinoma etc.), medulloblastoma, melanoma, meningiomas, multiple endocrine neoplasia, multiple myeloma, myelodysplastic syndrome, neuroblastoma, neuroendocrine tumors, ovarian cancer, pancreatic cancers, papillary thyroid carcinomas, parathyroid tumors, pediatric cancers, peripheral nerve sheath tumors, phaeochromocytoma, pituitary tumors, prostate cancer, posterious unveal melanoma, rare hematologic disorders, renal metastatic cancer, rhabdoid tumor, rhabdomysarcoma, sarcomas, skin cancer, soft-tissue sarcomas, squamous cell cancer, stomach cancer, synovial sarcoma, testicular cancer, thymic carcinoma, thymoma, thyroid metastatic cancer, and uterine cancers (carcinoma of the cervix, endometrial carcinoma, and leiomyoma).

In certain preferred embodiments the proliferative disorder will comprise a solid tumor including, but not limited to, adrenal, liver, kidney, bladder, breast, gastric, ovarian, cervical, uterine, esophageal, colorectal, prostate, pancreatic, lung (both small cell and non-small cell), thyroid, carcinomas, sarcomas, glioblastomas and various head and neck tumors. In other preferred embodiments, and as shown in the Examples below, the disclosed ADCs are especially effective at treating small cell lung cancer (SCLC) and non-small cell lung cancer (NSCLC) (e.g., squamous cell non-small cell lung cancer or squamous cell small cell lung cancer). In one embodiment, the lung cancer is refractory, relapsed or resistant to a platinum based agent (e.g., carboplatin, cisplatin, oxaliplatin, topotecan) and/or a taxane (e.g., docetaxel, paclitaxel, larotaxel or cabazitaxel).

In particularly preferred embodiments the disclosed ADCs may be used to treat small cell lung cancer. With regard to such embodiments the conjugated modulators may be administered to patients exhibiting limited stage disease. In other embodiments the disclosed ADCs will be administered to patients exhibiting extensive stage disease. In other preferred embodiments the disclosed ADCs will be administered to refractory patients (i.e., those who recur during or shortly after completing a course of initial therapy) or recurrent small cell lung cancer patients. Still other embodiments comprise the administration of the disclosed ADCs to sensitive patients (i.e., those whose relapse is longer than 2-3 months after primary therapy. In each case it will be appreciated that compatible ADCs may be used in combination with other anti-cancer agents depending the selected dosing regimen and the clinical diagnosis.

As discussed above the disclosed ADCs may further be used to prevent, treat or diagnose tumors with neuroendocrine features or phenotypes including neuroendocrine tumors. True or canonical neuroendocrine tumors (NETs) arising from the dispersed endocrine system are relatively rare, with an incidence of 2-5 per 100,000 people, but highly aggressive. Neuroendocrine tumors occur in the kidney, genitourinary tract (bladder, prostate, ovary, cervix, and endometrium), gastrointestinal tract (colon, stomach), thyroid (medullary thyroid cancer), and lung (small cell lung carcinoma and large cell neuroendocrine carcinoma). These tumors may secrete several hormones including serotonin and/or chromogranin A that can cause debilitating symptoms known as carcinoid syndrome. Such tumors can be denoted by positive immunohistochemical markers such as neuron-specific enolase (NSE, also known as gamma enolase, gene symbol=ENO2), CD56 (or NCAM1), chromogranin A (CHGA), and synaptophysin (SYP) or by genes known to exhibit elevated expression such as ASCL1. Unfortunately traditional chemotherapies have not been particularly effective in treating NETs and liver metastasis is a common outcome.

While the disclosed ADCs may be advantageously used to treat neuroendocrine tumors they may also be used to treat, prevent or diagnose pseudo neuroendocrine tumors (pNETs) that genotypically or phenotypically mimic, resemble or exhibit common traits with canonical neuroendocrine tumors. Pseudo neuroendocrine tumors or tumors with neuroendocrine features are tumors that arise from cells of the diffuse neuroendocrine system or from cells in which a neuroendocrine differentiation cascade has been aberrantly reactivated during the oncogenic process. Such pNETs commonly share certain phenotypic or biochemical characteristics with traditionally defined neuroendocrine tumors, including the ability to produce subsets of biologically active amines, neurotransmitters, and peptide hormones. Histologically, such tumors (NETs and pNETs) share a common appearance often showing densely connected small cells with minimal cytoplasm of bland cytopathology and round to oval stippled nuclei. For the purposes of the instant invention commonly expressed histological markers or genetic markers that may be used to define neuroendocrine and pseudo neuroendocrine tumors include, but are not limited to, chromogranin A, CD56, synaptophysin, PGP9.5, ASCL1 and neuron-specific enolase (NSE).

Accordingly the ADCs of the instant invention may beneficially be used to treat both pseudo neuroendocrine tumors and canonical neuroendocrine tumors. In this regard the ADCs may be used as described herein to treat neuroendocrine tumors (both NET and pNET) arising in the kidney, genitourinary tract (bladder, prostate, ovary, cervix, and endometrium), gastrointestinal tract (colon, stomach), thyroid (medullary thyroid cancer), and lung (small cell lung carcinoma and large cell neuroendocrine carcinoma). Moreover, the ADCs of the instant invention may be used to treat tumors expressing one or more markers selected from the group consisting of NSE, CD56, synaptophysin, chromogranin A, ASCL1 and PGP9.5 (UCHL1). That is, the present invention may be used to treat a subject suffering from a tumor that is $NSE^+$ or $CD56^+$ or $PGP9.5^+$ or $ASCL1^+$ or $SYP^+$ or $CHGA^+$ or some combination thereof.

With regard to hematologic malignancies it will be further be appreciated that the compounds and methods of the present invention may be particularly effective in treating a variety of B-cell lymphomas, including low grade/NHL follicular cell lymphoma (FCC), mantle cell lymphoma (MCL), diffuse large cell lymphoma (DLCL), small lymphocytic (SL) NHL, intermediate grade/follicular NHL, intermediate grade diffuse NHL, high grade immunoblastic NHL, high grade lymphoblastic NHL, high grade small non-cleaved cell NHL, bulky disease NHL, Waldenstrom's Macroglobulinemia, lymphoplasmacytoid lymphoma (LPL), mantle cell lymphoma (MCL), follicular lymphoma (FL), diffuse large cell lymphoma (DLCL), Burkitt's lymphoma (BL), AIDS-related lymphomas, monocytic B cell lymphoma, angioimmunoblastic lymphoadenopathy, small lymphocytic, follicular, diffuse large cell, diffuse small cleaved cell, large cell immunoblastic lymphoblastoma, small, non-cleaved, Burkitt's and non-Burkitt's, follicular, predominantly large cell; follicular, predominantly small cleaved cell; and follicular, mixed small cleaved and large cell lymphomas. See, Gaidono et al., "Lymphomas", IN CANCER: PRINCIPLES & PRACTICE OF ONCOLOGY, Vol. 2: 2131-2145 (DeVita et al., eds., 5.sup.th ed. 1997). It should be clear to those of skill in the art that these lymphomas will often have different names due to changing systems of classification, and that patients having lymphomas classified under different names may also benefit from the combined therapeutic regimens of the present invention.

The present invention also provides for a preventative or prophylactic treatment of subjects who present with benign or precancerous tumors. Beyond being a DLL3 associated disorder it is not believed that any particular type of tumor or proliferative disorder should be excluded from treatment using the present invention. However, the type of tumor cells may be relevant to the use of the invention in combination with secondary therapeutic agents, particularly chemotherapeutic agents and targeted anti-cancer agents.

Preferably the "subject" or "patient" to be treated will be human although, as used herein, the terms are expressly held to comprise any species including all mammals. Accordingly the subject/patient may be an animal, mammal, a placental mammal, a marsupial (e.g., kangaroo, wombat), a monotreme (e.g., duckbilled platypus), a rodent (e.g., a guinea pig, a hamster, a rat, a mouse), murine (e.g., a mouse), a lagomorph (e.g., a rabbit), avian (e.g., a bird), canine (e.g., a dog), feline (e.g., a cat), equine (e.g., a horse), porcine (e.g., a pig), ovine (e.g., a sheep), bovine (e.g., a cow), a primate, simian (e.g., a monkey or ape), a monkey (e.g., marmoset, baboon), an ape (e.g., gorilla, chimpanzee, orangutang, gibbon), or a human.

VIII. Articles of Manufacture

Pharmaceutical packs and kits comprising one or more containers, comprising one or more doses of a DLL3 ADCs are also provided. In certain embodiments, a unit dosage is provided wherein the unit dosage contains a predetermined amount of a composition comprising, for example, an anti-DLL3 conjugate, with or without one or more additional agents. For other embodiments, such a unit dosage is supplied in single-use prefilled syringe for injection. In still other embodiments, the composition contained in the unit dosage may comprise saline, sucrose, or the like; a buffer, such as phosphate, or the like; and/or be formulated within a stable and effective pH range. Alternatively, in certain embodiments, the conjugate composition may be provided as a lyophilized powder that may be reconstituted upon addition of an appropriate liquid, for example, sterile water or saline solution. In certain preferred embodiments, the composition comprises one or more substances that inhibit protein aggregation, including, but not limited to, sucrose and arginine. Any label on, or associated with, the container(s) indicates that the enclosed conjugate composition is used for treating the neoplastic disease condition of choice.

The present invention also provides kits for producing single-dose or multi-dose administration units of a DLL3 conjugates and, optionally, one or more anti-cancer agents. The kit comprises a container and a label or package insert on or associated with the container. Suitable containers include, for example, bottles, vials, syringes, etc. The containers may be formed from a variety of materials such as glass or plastic and contain a pharmaceutically effective amount of the disclosed DLL3 conjugates in a conjugated or unconjugated form. In other preferred embodiments the container(s) comprise a sterile access port (for example the container may be an intravenous solution bag or a vial having a stopper pierceable by a hypodermic injection needle). Such kits will generally contain in a suitable container a pharmaceutically acceptable formulation of the DLL3 conjugate and, optionally, one or more anti-cancer agents in the same or different containers. The kits may also contain other pharmaceutically acceptable formulations, either for diagnosis or combined therapy. For example, in addition to the DLL3 conjugates of the invention such kits may contain any one or more of a range of anti-cancer agents such as chemotherapeutic or radiotherapeutic drugs; anti-angiogenic agents; anti-metastatic agents; targeted anti-cancer agents; cytotoxic agents; and/or other anti-cancer agents.

More specifically the kits may have a single container that contains the DLL3 ADCs, with or without additional components, or they may have distinct containers for each desired agent. Where combined therapeutics are provided for conjugation, a single solution may be pre-mixed, either in a molar equivalent combination, or with one component in excess of the other. Alternatively, the DLL3 conjugates and any optional anti-cancer agent of the kit may be maintained separately within distinct containers prior to administration to a patient. The kits may also comprise a second/third container means for containing a sterile, pharmaceutically acceptable buffer or other diluent such as bacteriostatic water for injection (BWFI), phosphate-buffered saline (PBS), Ringer's solution and dextrose solution.

When the components of the kit are provided in one or more liquid solutions, the liquid solution is preferably an aqueous solution, with a sterile aqueous or saline solution being particularly preferred. However, the components of the kit may be provided as dried powder(s). When reagents or components are provided as a dry powder, the powder can be reconstituted by the addition of a suitable solvent. It is envisioned that the solvent may also be provided in another container.

As indicated briefly above the kits may also contain a means by which to administer the antibody conjugate and any optional components to an animal or patient, e.g., one or more needles, I.V. bags or syringes, or even an eye dropper, pipette, or other such like apparatus, from which the formulation may be injected or introduced into the animal or applied to a diseased area of the body. The kits of the present invention will also typically include a means for containing the vials, or such like, and other component in close confinement for commercial sale, such as, e.g., injection or blow-molded plastic containers into which the desired vials and other apparatus are placed and retained. Any label or package insert indicates that the DLL3 conjugate composition is used for treating cancer, for example small cell lung cancer.

In other preferred embodiments the conjugates of the instant invention may be used in conjunction with, or comprise, diagnostic or therapeutic devices useful in the prevention or treatment of proliferative disorders. For example, in on preferred embodiment the compounds and compositions of the instant invention may be combined with certain diagnostic devices or instruments that may be used to detect, monitor, quantify or profile cells or marker compounds involved in the etiology or manifestation of proliferative disorders. For selected embodiments the marker compounds may comprise NSE, CD56, synaptophysin, chromogranin A, and PGP9.5.

In particularly preferred embodiments the devices may be used to detect, monitor and/or quantify circulating tumor cells either in vivo or in vitro (see, for example, WO 2012/0128801 which is incorporated herein by reference). In still other preferred embodiments, and as discussed above, circulating tumor cells may comprise cancer stem cells.

IX. Sequence Listing Summary

Appended to the instant application is a sequence listing comprising a number of nucleic acid and amino acid sequences. The following TABLE 2 provides a summary of the included sequences.

TABLE 2

| SEQ ID NO. | Description |
| --- | --- |
| 1 | DLL3 isoform 1 protein |
| 2 | DLL3 isoform 2 protein |
| 3 | Epitope SC16.23 protein |
| 4 | Epitope SC16.34 & SC 16.56 protein |
| 5 | Kappa constant region protein |
| 6 | IgGI constant region protein |
| 7-19 | Save |

TABLE 2-continued

| SEQ ID NO. | Description |
|---|---|
| 20 | SC16.3 VL DNA (aligned with encoded protein) |
| 21 | SC16.3 VL protein |
| 22 | SC16.3 VH DNA (aligned with encoded protein) |
| 23 | SC16.3 VH protein |
| 24-387 | Additional murine clones as in SEQ ID NOs: 20-23 |
| 388-407 | Humanized clones as in SEQ ID NOs: 20-23 |
| 408, 409, 410 | hSC16.13 CDRL1, CDRL2, CDRL3 |
| 411, 412, 413 | hSC16.13 CDRH1, CDRH2, CDRH3 |
| 414, 415, 416 | hSC16.15 CDRL1, CDRL2, CDRL3 |
| 417, 418, 419 | hSC16.15 CDRH1, CDRH2, CDRH3 |
| 420, 421, 422 | hSC16.25 CDRL1, CDRL2, CDRL3 |
| 423, 424, 425 | hSC16.25 CDRH1, CDRH2, CDRH3 |
| 426, 427, 428 | hSC16.34 CDRL1, CDRL2, CDRL3 |
| 429, 430, 431 | hSC16.34 CDRH1, CDRH2, CDRH3 |
| 432, 433, 434 | hSC16.56 CDRL1, CDRL2, CDRL3 |
| 435, 436, 437 | hSC16.56 CDRH1, CDRH2, CDRH3 |

X. Miscellaneous

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. More specifically, as used in this specification and the appended claims, the singular forms "a," "an" and "the" include plural referents unless the context clearly dictates otherwise. Thus, for example, reference to "a protein" includes a plurality of proteins; reference to "a cell" includes mixtures of cells, and the like. In addition, ranges provided in the specification and appended claims include both end points and all points between the end points. Therefore, a range of 2.0 to 3.0 includes 2.0, 3.0, and all points between 2.0 and 3.0.

Generally, nomenclature used in connection with, and techniques of, cell and tissue culture, molecular biology, immunology, microbiology, genetics and protein and nucleic acid chemistry and hybridization described herein are those well known and commonly used in the art. The methods and techniques of the present invention are generally performed according to conventional methods well known in the art and as described in various general and more specific references that are cited and discussed throughout the present specification unless otherwise indicated. See, e.g., Abbas et al., Cellular and Molecular Immunology, 6$^{th}$ ed., W.B. Saunders Company (2010); Sambrook J. & Russell D. *Molecular Cloning: A Laboratory Manual*, 3rd ed., Cold Spring Harbor Laboratory Press, Cold Spring Harbor, N.Y. (2000); Ausubel et al., *Short Protocols in Molecular Biology: A Compendium of Methods from Current Protocols in Molecular Biology*, Wiley, John & Sons, Inc. (2002); *Harlow and Lane Using Antibodies: A Laboratory Manual*, Cold Spring Harbor Laboratory Press, Cold Spring Harbor, N.Y. (1998); and Coligan et al., *Short Protocols in Protein Science*, Wiley, John & Sons, Inc. (2003). Enzymatic reactions and purification techniques are performed according to manufacturer's specifications, as commonly accomplished in the art or as described herein. The nomenclature used in connection with, and the laboratory procedures and techniques of, analytical chemistry, synthetic organic chemistry, and medicinal and pharmaceutical chemistry described herein are those well known and commonly used in the art. Moreover, any section headings used herein are for organizational purposes only and are not to be construed as limiting the subject matter described.

Certain abbreviations used herein:
Ac acetyl
Acm acetamidomethyl
Alloc allyloxycarbonyl
Boc di-tert-butyl dicarbonate
t-Bu tert-butyl
Bzl benzyl, where Bzl-OMe is methoxybenzyl and Bzl-Me is methylbenzene
Cbz or Z benzyloxy-carbonyl, where Z—Cl and Z—Br are chloro- and bromobenzyloxy carbonyl respectively
DMF N,N-dimethylformamide
Dnp dinitrophenyl
DTT dithiothreitol
Fmoc 9H-fluoren-9-ylmethoxycarbonyl
imp N-10 imine protecting group: 3-(2-methoxyethoxy) propanoate-Val-Ala-PAB MC-OSu maleimidocaproyl-O—N-succinimide
Moc methoxycarbonyl
MP maleimidopropanamide
Mtr 4-methoxy-2,3,6-trimethtylbenzenesulfonyl
PAB para-aminobenzyloxycarbonyl
PEG ethyleneoxy
PNZ p-nitrobenzyl carbamate
Psec 2-(phenylsulfonyl)ethoxycarbonyl
TBDMS tert-butyldimethylsilyl
TBDPS tert-butyldiphenylsilyl
Teoc 2-(trimethylsilyl)ethoxycarbonyl
Tos tosyl
Troc 2,2,2-trichlorethoxycarbonyl chloride
Trt trityl
Xan xanthyl

EXAMPLES

The present invention, thus generally described above, will be understood more readily by reference to the following examples, which are provided by way of illustration and are not intended to be limiting of the instant invention. The examples are not intended to represent that the experiments below are all or the only experiments performed. Unless indicated otherwise, parts are parts by weight, molecular weight is weight average molecular weight, temperature is in degrees Centigrade, and pressure is at or near atmospheric.

Example 1

Fabrication of PBD Drug-Linker Compounds

PBD drug-linker compounds DL1-DL5 were synthesized as follows:

A. General Experimental Methods

Optical rotations were measured on an ADP 220 polarimeter (Bellingham Stanley Ltd.) and concentrations (c) are given in g/100 mL. Melting points were measured using a digital melting point apparatus (Electrothermal). IR spectra were recorded on a Perkin-Elmer Spectrum 1000 FT IR Spectrometer. $^1$H and $^{13}$C NMR spectra were acquired at 300 K using a Bruker Avance NMR spectrometer at 400 and 100 MHz, respectively. Chemical shifts are reported relative to TMS (δ=0.0 ppm), and signals are designated as s (singlet), d (doublet), t (triplet), dt (double triplet), dd (doublet of doublets), ddd (double doublet of doublets) or m (multiplet), with coupling constants given in Hertz (Hz). Mass spectroscopy (MS) data were collected using a Waters Micromass ZQ instrument coupled to a Waters 2695 HPLC with a Waters 2996 PDA. Waters Micromass ZQ parameters used were: Capillary (kV), 3.38; Cone (V), 35; Extractor (V), 3.0; Source temperature (° C.), 100; Desolvation Temperature (° C.), 200; Cone flow rate (L/h), 50; De-solvation flow rate (L/h), 250. High-resolution mass spectroscopy (HRMS) data were recorded on a Waters Micromass QTOF Global in positive W-mode using metal-coated borosilicate glass tips to introduce the samples into the instrument. Thin Layer Chromatography (TLC) was performed on silica gel aluminium plates (Merck 60, $F_{254}$), and flash chromatography utilised silica gel (Merck 60, 230-400 mesh ASTM). Except for the HOBt (NovaBiochem) and solid-supported reagents (Argonaut), all other chemicals and solvents were purchased from Sigma-Aldrich and were used as supplied without further purification. Anhydrous solvents were prepared by distillation under a dry nitrogen atmosphere in the presence of an appropriate drying agent, and were stored over 4 Å molecular sieves or sodium wire. Petroleum ether refers to the fraction boiling at 40-60° C.

In generating the disclosed compounds LC/MS was performed using two slightly different procedures. The default procedure was the first method described which was used unless otherwise indicated.

Method 1 (Default Method, Used Unless Stated Otherwise)—

The HPLC (Waters Alliance 2695) was run using a mobile phase of water (A) (formic acid 0.1%) and acetonitrile (B) (formic acid 0.1%). Gradient: initial composition 5% B held over 1.0 min, then increase from 5% B to 95% B over a 3 min period. The composition was held for 0.1 min at 95% B, then returned to 5% B in 0.03 minutes and hold there for 0.87 min. Total gradient run time equals 5 minutes.

Method 2—

The HPLC (Waters Alliance 2695) was run using a mobile phase of water (A) (formic acid 0.1%) and acetonitrile (B) (formic acid 0.1%). Gradient: initial composition 5% B held over 1.0 minute, then increase from 5% B to 95% B over a 2.5 minute period. The composition was held for 0.5 minutes at 95% B, then returned to 5% B in 0.1 minutes and hold there for 0.9 min. Total gradient run time equals 5 minutes.

For both methods the flow rate was 3.0 mL/min, 400 μL was split via a zero dead volume tee piece which passes into the mass spectrometer. Wavelength detection range: 220 to 400 nm. Function type: diode array (535 scans). Column: Phenomenex Onyx Monolithic C18 50×4.60 mm.

Reverse phase flash purification conditions were as follows: The Flash purification system (Varian 971-Fp) was run using a mobile phase of water (A) and acetonitrile (B). Gradient: initial composition 5% B over 20 C.V. (Column Volume) then 5% B to 70% B within 60 C.V. The composition was held for 15 C.V. at 95% B, and then returned to 5% B in 5 C.V. and held at 5% B for 10 C.V. Total gradient run time equals 120 C.V. Flow rate 6.0 mL/min. Wavelength detection range: 254 nm. Column: Agilent AX1372-1 SF10-5.5 gC8.

Preparative HPLC was carried out as follows: Reverse-phase ultra-high-performance liquid chromatography (UPLC) was carried out on Phenomenex Gemini NX 5μ C-18 columns of the following dimensions: 150×4.6 mm for analysis, and 150×21.20 mm for preparative work. All UPLC experiments were performed with gradient conditions. Eluents used were solvent A ($H_2O$ with 0.1% Formic acid) and solvent B ($CH_3CN$ with 0.1% Formic acid). Flow rates used were 1.0 ml/min for analytical, and 20.0 ml/min for preparative HPLC. Detection was at 254 and 280 nm.

B. Synthesis of Drug-Linker DL1 (Route 1)

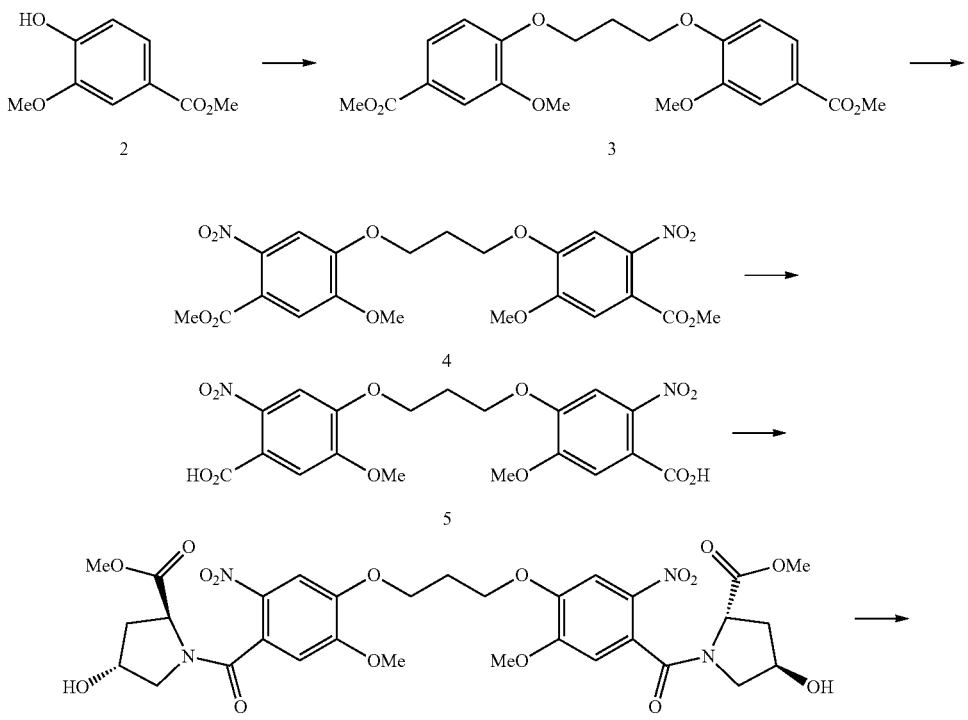

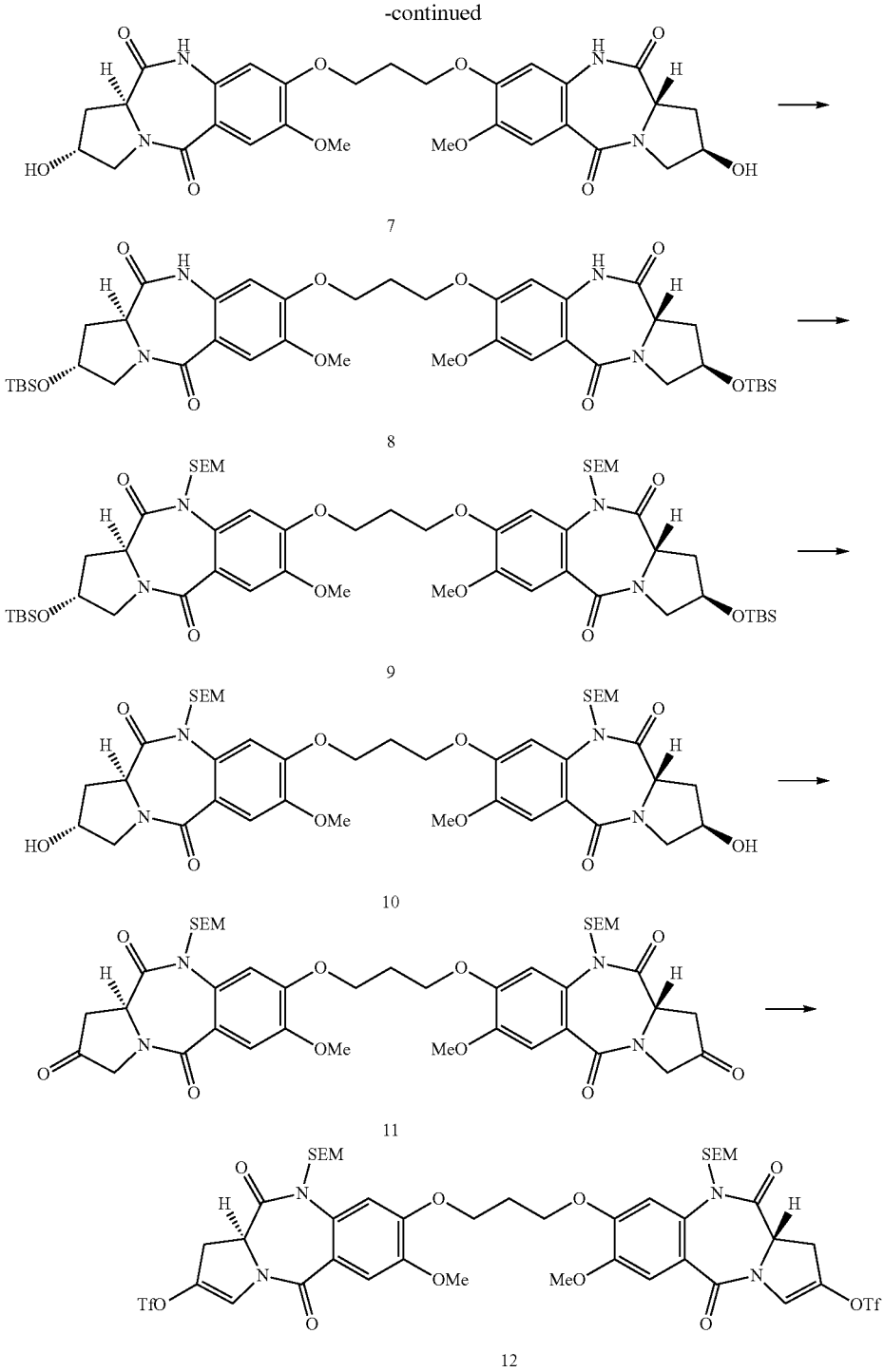

7

8

9

10

11

12

(a) 1',3'-Bis[2-methoxy-4-(methoxycarbonyl)phenoxy]propane (3)

Diisopropyl azodicarboxylate (71.3 mL, 73.2 g, 362 mmol) was added drop-wise over a period of 60 min to an overhead stirred solution of methyl vanillate 2 (60.0 g, 329 mmol) and $Ph_3P$ (129.4 g, 494 mmol) in anhydrous THF (800 mL) at 0-5° C. (ice/acetone) under a nitrogen atmosphere. The reaction mixture was allowed to stir at 0-5° C. for an additional 1 hour after which time a solution of 1,3-propanediol (11.4 mL, 12.0 g, 158 mmol) in THF (12 mL) was added drop-wise over a period of 20 min. The reaction mixture was allowed to warm to room temperature and stirred for 5 days. The resulting white precipitate 3 was collected by vacuum filtration, washed with THF and dried in a vacuum desiccator to constant weight. Yield=54.7 g (84% based on 1,3-propanediol). Purity satisfactory by LC/MS (3.20 min (ES+) m/z (relative intensity) 427 ([M+Na]$^+$., 10); $^1$H NMR (400 MHz, CDCl$_3$) δ 7.64 (dd, 2H, J=1.8, 8.3 Hz), 7.54 (d, 2H, J=1.8 Hz), 6.93 (d, 2H, J=8.5 Hz), 4.30 (t, 4H, J=6.1 Hz), 3.90 (s, 6H), 3.89 (s, 6H), 2.40 (p, 2H, J=6.0 Hz).

(b) 1',3'-Bis[2-methoxy-4-(methoxycarbonyl)-5-nitrophenoxy]propane (4)

Solid Cu(NO$_3$)$_2$.3H$_2$O (81.5 g, 337.5 mmol) was added slowly to an overhead stirred slurry of the bis-ester 3 (54.7 g, 135 mmol) in acetic anhydride (650 mL) at 0-5° C. (ice/acetone). The reaction mixture was allowed to stir for 1 hour at 0-5° C. and then allowed to warm to room temperature. A mild exotherm (ca. 40-50° C.), accompanied by thickening of the mixture and evolution of NO$_2$ was observed at this stage. Additional acetic anhydride (300 mL) was added and the reaction mixture was allowed to stir for 16 hours at room temperature. The reaction mixture was poured on to ice (~1.5 L), stirred and allowed to return to room temperature. The resulting yellow precipitate was collected by vacuum filtration and dried in a desiccator to afford the desired bis-nitro compound 4 as a yellow solid. Yield=66.7 g (100%). Purity satisfactory by LC/MS (3.25 min (ES+) m/z (relative intensity) 517 ([M+Na]$^+$., 40); 1H NMR (400 MHz, CDCl$_3$) δ 7.49 (s, 2H), 7.06 (s, 2H), 4.32 (t, 4H, J=6.0 Hz), 3.95 (s, 6H), 3.90 (s, 6H), 2.45-2.40 (m, 2H).

(c) 1',3'-Bis(4-carboxy-2-methoxy-5-nitrophenoxy) propane (5)

A slurry of the methyl ester 4 (66.7 g, 135 mmol) in THF (700 mL) was treated with 1N NaOH (700 mL) and the reaction mixture was allowed to stir vigorously at room temperature. After 4 days stirring, the slurry became a dark coloured solution which was subjected to rotary evaporation under reduced pressure to remove THF. The resulting aqueous residue was acidified to pH 1 with concentrated HCl and the colourless precipitate 5 was collected and dried thoroughly in a vacuum oven (50° C.). Yield=54.5 g (87%). Purity satisfactory by LC/MS (2.65 min (ES+) m/z (relative intensity) 489 ([M+Na]$^+$., 30)); $^1$H NMR (400 MHz, DMSO-d$_6$) δ 7.62 (s, 2H), 7.30 (s, 2H), 4.29 (t, 4H, J=6.0 Hz), 3.85 (s, 6H), 2.30-2.26 (m, 2H).

(d) 1,1'-[[(Propane-1,3-diyl)dioxy]bis[(5-methoxy-2-nitro-1,4-phenylene)carbonyl]]bis[(2S,4R)-methyl-4-hydroxypyrrolidine-2-carboxylate](6)

Oxalyl chloride (24.5 mL, 35.6 g, 281 mmol) was added to a stirred suspension of the nitrobenzoic acid 5 (43 g, 92.3 mmol) and DMF (6 mL) in anhydrous DCM (600 mL). Following initial effervescence the reaction suspension became a solution and the mixture was allowed to stir at room temperature for 16 hours. Conversion to the acid chloride was confirmed by treating a sample of the reaction mixture with MeOH and the resulting bis-methyl ester was observed by LC/MS. The majority of solvent was removed by evaporation under reduced pressure; the resulting concentrated solution was re-dissolved in a minimum amount of dry DCM and triturated with diethyl ether. The resulting yellow precipitate was collected by filtration, washed with cold diethyl ether and dried for 1 hour in a vacuum oven at 40° C. The solid acid chloride was added portionwise over a period of 25 min to a stirred suspension of (2S,4R)-methyl-4-hydroxypyrrolidine-2-carboxylate hydrochloride (38.1 g, 210 mmol) and TEA (64.5 mL, g, 463 mmol) in DCM (400 mL) at −40° C. (dry ice/CH$_3$CN). Immediately, the reaction was complete as judged by LC/MS (2.47 min (ES+) m/z (relative intensity) 721 ([M+H]$^+$., 100). The mixture was diluted with DCM (200 mL) and washed with 1N HCl (300 mL), saturated NaHCO$_3$ (300 mL), brine (400 mL), dried (MgSO$_4$), filtered and the solvent evaporated in vacuo to give the pure product 6 as an orange solid (66.7 g, 100%). [α]$^{22}_D$=−46.1° (c=0.47, CHCl$_3$); $^1$H NMR (400 MHz, CDCl$_3$) (rotamers) δ 7.63 (s, 2H), 6.82 (s, 2H), 4.79-4.72 (m, 2H), 4.49-4.28 (m, 6H), 3.96 (s, 6H), 3.79 (s, 6H), 3.46-3.38 (m, 2H), 3.02 (d, 2H, J=11.1 Hz), 2.48-2.30 (m, 4H), 2.29-2.04 (m, 4H); $^{13}$C NMR (100 MHz, CDCl$_3$) (rotamers) δ 172.4, 166.7, 154.6, 148.4, 137.2, 127.0, 109.7, 108.2, 69.7, 65.1, 57.4, 57.0, 56.7, 52.4, 37.8, 29.0; IR (ATR, CHCl$_3$) 3410 (br), 3010, 2953, 1741, 1622, 1577, 1519, 1455, 1429, 1334, 1274, 1211, 1177, 1072, 1050, 1008, 871 cm$^{-1}$; MS (ES$^+$) m/z (relative intensity) 721 ([M+H]$^+$., 47), 388 (80); HRMS [M+H]$^+$. theoretical C$_{31}$H$_{36}$N$_4$O$_{16}$ m/z 721.2199. found (ES$^+$) m/z 721.2227.

(e) 1,1'-[[(Propane-1,3-diyl)dioxy]bis(11aS,2R)-2-(hydroxy)-7-methoxy-1,2,3,10,11,11a-hexahydro-5H-pyrrolo[2,1-c][1,4]-benzodiazepin-5,11-dione](7)

Method A:

A solution of the nitro-ester 6 (44 g, 61.1 mmol) in MeOH (2.8 L) was added to freshly purchased Raney® nickel (~50 g of a ~50% slurry in H$_2$O) and anti-bumping granules in a 5 L 3-neck round bottomed flask. The mixture was heated at reflux and then treated dropwise with a solution of hydrazine hydrate (21.6 mL, 22.2 g, 693 mmol) in MeOH (200 mL) at which point vigorous effervescence was observed. When the addition was complete (45 min) additional Raney® nickel was added carefully until effervescence had ceased and the initial yellow colour of the reaction mixture was discharged. The mixture was heated at reflux for a further 5 min at which point the reaction was deemed complete by TLC (90:10 v/v CHCl$_3$/MeOH) and LC/MS (2.12 min (ES+) m/z (relative intensity) 597 ([M+H]$^+$., 100)). The reaction mixture was filtered hot immediately through a sinter funnel containing celite with vacuum suction. The filtrate was reduced in volume by evaporation in vacuo at which point a colourless precipitate formed which was collected by filtration and dried in a vacuum desiccator to provide 7 (31 g, 85%). [α]$^{27}$D=+404° (c=0.10, DMF); $^1$H NMR (400 MHz, DMSO-d$_6$) δ 10.2 (s, 2H, NH), 7.26 (s, 2H), 6.73 (s, 2H), 5.11 (d, 2H, J=3.98 Hz, OH), 4.32-4.27 (m, 2H), 4.19-4.07 (m, 6H), 3.78 (s, 6H), 3.62 (dd, 2H, J=12.1, 3.60 Hz), 3.43 (dd, 2H, J=12.0, 4.72 Hz), 2.67-2.57 (m, 2H), 2.26 (p, 2H, J=5.90 Hz), 1.99-1.89 (m, 2H); $^{13}$C NMR (100 MHz, DMSO-d$_6$) δ 169.1, 164.0, 149.9, 144.5, 129.8, 117.1, 111.3, 104.5, 54.8, 54.4, 53.1, 33.5, 27.5; IR (ATR, neat) 3438, 1680, 1654, 1610, 1605, 1516, 1490, 1434, 1379, 1263, 1234, 1216, 1177, 1156, 1115, 1089, 1038, 1018, 952, 870 cm$^{-1}$; MS (ES$^+$) m/z (relative intensity) 619 ([M+Na]', 10), 597 ([M+H]$^+$., 52), 445 (12), 326 (11); HRMS [M+H]$^+$. theoretical C$_{29}$H$_{32}$N$_4$O$_{10}$ m/z 597.2191. found (ES$^+$) m/z 597.2205.

Method B:

A suspension of 10% Pd/C (7.5 g, 10% w/w) in DMF (40 mL) was added to a solution of the nitro-ester 6 (75 g, 104 mmol) in DMF (360 mL). The suspension was hydrogenated in a Parr hydrogenation apparatus over 8 hours. Progress of the reaction was monitored by LC/MS after the hydrogen uptake had stopped. Solid Pd/C was removed by filtration and the filtrate was concentrated by rotary evaporation under vacuum (below 10 mbar) at 40° C. to afford a dark oil containing traces of DMF and residual charcoal. The residue was digested in EtOH (500 mL) at 40° C. on a water bath (rotary evaporator bath) and the resulting suspension was filtered through celite and washed with ethanol (500 mL) to give a clear filtrate. Hydrazine hydrate (10 mL, 321 mmol) was added to the solution and the reaction mixture was heated at reflux. After 20 minutes the formation of a white precipitate was observed and reflux was allowed to continue for a further 30 minutes. The mixture was allowed to cool down to room temperature and the precipitate was retrieved by filtration, washed with diethyl ether (2:1 volume of precipitate) and dried in a vacuum desiccator to provide 7 (50 g, 81%). Analytical data for method B: Identical to those obtained for Method A (optical rotation, $^1$H NMR, LC/MS and TLC).

(f) 1,1'-[[(Propane-1,3-diyl)dioxy]bis(11aS,2R)-2-(tert-butyldimethylsilyloxy)-7-methoxy-1,2,3,10,11,11a-hexahydro-5H-pyrrolo[2,1-c][1,4]-benzodiazepin-5,11-dione](8)

TBSCl (27.6 g, 182.9 mmol) and imidazole (29.9 g, 438.8 mmol) were added to a cloudy solution of the tetralactam 7 (21.8 g, 36.6 mmol) in anhydrous DMF (400 mL) at 0° C. (ice/acetone). The mixture was allowed to stir under a nitrogen atmosphere for 3 hours after which time the reaction was deemed complete as judged by LC/MS (3.90 min (ES+) m/z (relative intensity) 825 ([M+H]$^+$, 100). The reaction mixture was poured onto ice (~1.75 L) and allowed to warm to room temperature with stirring. The resulting white precipitate was collected by vacuum filtration, washed with H$_2$O, diethyl ether and dried in the vacuum desiccator to provide pure 8 (30.1 g, 99%). $[\alpha]^{23}_D$=+234° (c=0.41, CHCl$_3$); 1H NMR (400 MHz, CDCl$_3$) δ 8.65 (s, 2H, NH), 7.44 (s, 2H), 6.54 (s, 2H), 4.50 (p, 2H, J=5.38 Hz), 4.21-4.10 (m, 6H), 3.87 (s, 6H), 3.73-3.63 (m, 4H), 2.85-2.79 (m, 2H), 2.36-2.29 (m, 2H), 2.07-1.99 (m, 2H), 0.86 (s, 18H), 0.08 (s, 12H); $^{13}$C NMR (100 MHz, CDCl$_3$) δ 170.4, 165.7, 151.4, 146.6, 129.7, 118.9, 112.8, 105.3, 69.2, 65.4, 56.3, 55.7, 54.2, 35.2, 28.7, 25.7, 18.0, −4.82 and −4.86; IR (ATR, CHCl$_3$) 3235, 2955, 2926, 2855, 1698, 1695, 1603, 1518, 1491, 1446, 1380, 1356, 1251, 1220, 1120, 1099, 1033 cm$^-$; MS (ES$^+$) m/z (relative intensity) 825 ([M+H]$^+$, 62), 721 (14), 440 (38); HRMS [M+H]$^+$. theoretical C$_{41}$H$_{60}$N$_4$O$_{10}$Si$_2$ m/z 825.3921. found (ES$^+$) m/z 825.3948.

(g) 1,1'-[[(Propane-1,3-diyl)dioxy]bis(11aS,2R)-2-(tert-butyldimethylsilyloxy)-7-methoxy-10-((2-(trimethylsilyl)ethoxy)methyl)-1,2,3,10,11,11a-hexahydro-5H-pyrrolo[2,1-c][1,4]-benzodiazepin-5,11-dione](9)

A solution of n-BuLi (68.3 mL of a 1.6 M solution in hexane, 109 mmol) was added dropwise to a stirred suspension of the tetralactam 8 (30.08 g, 36.4 mmol) in anhydrous THF (600 mL) at −30° C. (dry ice/ethylene glycol) under a nitrogen atmosphere. The reaction mixture was allowed to stir at this temperature for 1 hour (now a reddish orange colour) at which point a solution of SEMCl (19.3 mL, 18.2 g, 109 mmol) in anhydrous THF (120 mL) was added dropwise. The reaction mixture was allowed to slowly warm to room temperature and was stirred for 16 hours under a nitrogen atmosphere. The reaction was deemed complete as judged by TLC (EtOAc) and LC/MS (4.77 min (ES+) m/z (relative intensity) 1085 ([M+H]$^+$, 100). The THF was removed by evaporation in vacuo and the resulting residue dissolved in EtOAc (750 mL), washed with H$_2$O (250 mL), brine (250 mL), dried (MgSO$_4$) filtered and evaporated in vacuo to provide the crude N10-SEM-protected tetralactam 9 as an oil (max$^m$ 39.5 g, 100%). Product carried through to next step without purification. $[\alpha]^{23}_D$=+163° (c=0.41, CHCl$_3$); $^1$H NMR (400 MHz, CDCl$_3$) δ 7.33 (s, 2H), 7.22 (s, 2H), 5.47 (d, 2H, J=9.98 Hz), 4.68 (d, 2H, J=9.99 Hz), 4.57 (p, 2H, J=5.77 Hz), 4.29-4.19 (m, 6H), 3.89 (s, 6H), 3.79-3.51 (m, 8H), 2.87-2.81 (m, 2H), 2.41 (p, 2H, J=5.81 Hz), 2.03-1.90 (m, 2H), 1.02-0.81 (m, 22H), 0.09 (s, 12H), 0.01 (s, 18H); $^{13}$C NMR (100 MHz, CDCl$_3$) δ 170.0, 165.7, 151.2, 147.5, 133.8, 121.8, 111.6, 106.9, 78.1, 69.6, 67.1, 65.5, 56.6, 56.3, 53.7, 35.6, 30.0, 25.8, 18.4, 18.1, −1.24, −4.73; IR (ATR, CHCl$_3$) 2951, 1685, 1640, 1606, 1517, 1462, 1433, 1360, 1247, 1127, 1065 cm$^{-1}$; MS (ES$^+$) m/z (relative intensity) 1113 ([M+Na]$^+$., 48), 1085 ([M+H]$^+$., 100), 1009 (5), 813 (6); HRMS [M+H]$^+$. theoretical C$_{53}$H$_{88}$N$_4$O$_{12}$Si$_4$ m/z 1085.5548. found (ES$^+$) m/z 1085.5542.

(h) 1,1'-[[(Propane-1,3-diyl)dioxy]bis(11aS,2R)-2-hydroxy-7-methoxy-10-((2-(trimethylsilyl)ethoxy)methyl)-1,2,3,10,11,11a-hexahydro-5H-pyrrolo[2,1-c][1,4]-benzodiazepin-5,11-dione](10)

A solution of TBAF (150 mL of a 1.0 M solution in THF, 150 mmol) was added to a stirred solution of the crude bis-silyl ether 9 [84.0 g (max$^m$ 56.8 g), 52.4 mmol] in THF (800 mL) at room temperature. After stirring for 1 hour, analysis of the reaction mixture by TLC (95:5 v/v CHCl$_3$/MeOH) revealed completion of reaction. The THF was removed by evaporation under reduced pressure at room temperature and the resulting residue dissolved in EtOAc (500 mL) and washed with NH$_4$Cl (300 mL). The combined organic layers were washed with brine (60 mL), dried (MgSO$_4$), filtered and evaporated under reduced pressure to provide the crude product. Purification by flash chromatography (gradient elution: 100% CHCl$_3$ to 96:4 v/v CHCl$_3$/MeOH) gave the pure tetralactam 10 as a white foam (36.0 g, 79%). LC/MS 3.33 min (ES+) m/z (relative intensity) 879 ([M+Na]$^+$., 100), 857 ([M+H]$^+$., 40); $[\alpha]^{23}_D$=+202° (c=0.34, CHCl$_3$); $^1$H NMR (400 MHz, CDCl$_3$) δ 7.28 (s, 2H), 7.20 (s, 2H), 5.44 (d, 2H, J=10.0 Hz), 4.72 (d, 2H, J=10.0 Hz), 4.61-4.58 (m, 2H), 4.25 (t, 4H, J=5.83 Hz), 4.20-4.16 (m, 2H), 3.91-3.85 (m, 8H), 3.77-3.54 (m, 6H), 3.01 (br s, 2H, OH), 2.96-2.90 (m, 2H), 2.38 (p, 2H, J=5.77 Hz), 2.11-2.05 (m, 2H), 1.00-0.91 (m, 4H), 0.00 (s, 18H); $^{13}$C NMR (100 MHz, CDCl$_3$) δ 169.5, 165.9, 151.3, 147.4, 133.7, 121.5, 111.6, 106.9, 79.4, 69.3, 67.2, 65.2, 56.5, 56.2, 54.1, 35.2, 29.1, 18.4, −1.23; IR (ATR, CHCl$_3$) 2956, 1684, 1625, 1604, 1518, 1464, 1434, 1361, 1238, 1058, 1021 cm$^{-1}$; MS (ES$^+$) m/z (relative intensity) 885 ([M+29]$^+$., 70), 857 ([M+H]$^+$., 100), 711 (8), 448 (17); HRMS [M+H]$^+$. theoretical C$_{41}$H$_{60}$N$_4$O$_{12}$Si$_2$ m/z 857.3819. found (ES$^+$) m/z 857.3826.

(i) 1,1'-[[(Propane-1,3-diyl)dioxy]bis(11aS)-7-methoxy-2-oxo-10-((2-(trimethylsilyl)ethoxy)methyl)-1,2,3,10,11,11a-hexahydro-5H-pyrrolo[2,1-c][1,4]-benzodiazepin-5,11-dione](11)

Diol 10 (25.6 g, 30 mmol, 1 eq.), NaOAc (6.9 g, 84 mmol, 2.8 eq.) and TEMPO (188 mg, 1.2 mmol, 0.04 eq.) were dissolved in DCM (326 mL) under Ar. This was cooled to −8° C. (internal temperature) and TCCA (9.7 g, 42 mmol, 1.4 eq.) was added portionwise over 15 minutes. TLC (EtOAc) and LC/MS [3.60 min. (ES+) m/z (relative intensity) 854.21 ([M+H]$^+$., 40), (ES−) m/z (relative intensity) 887.07 ([M−H+Cl]$^-$., 10)] after 30 minutes indicated that reaction was complete. Cold DCM (200 mL) was added and the mixture was filtered through a pad of Celite before washing with a solution of saturated sodium hydrogen carbonate/sodium thiosulfate (1:1 v/v; 200 mL×2). The organic layer was dried with MgSO$_4$, filtered and the solvent removed in vacuo to yield a yellow/orange sponge (25.4 g, 99%). LC/MS [3.60 min. (ES+) m/z (relative intensity) 854.21 ([M+H]$^+$., 40); [α]$^{20}_D$=+2910 (c=0.26, CHCl$_3$); $^1$H NMR (400 MHz, CDCl$_3$) δ 7.32 (s, 2H), 7.25 (s, 2H), 5.50 (d, 2H, J=10.1 Hz), 4.75 (d, 2H, J=10.1 Hz), 4.60 (dd, 2H, J=9.85, 3.07 Hz), 4.31-4.18 (m, 6H), 3.89-3.84 (m, 8H), 3.78-3.62 (m, 4H), 3.55 (dd, 2H, J=19.2, 2.85 Hz), 2.76 (dd, 2H, J=19.2, 9.90 Hz), 2.42 (p, 2H, J=5.77 Hz), 0.98-0.91 (m, 4H), 0.00 (s, 18H); $^{13}$C NMR (100 MHz, CDCl$_3$) δ 206.8, 168.8, 165.9, 151.8, 148.0, 133.9, 120.9, 111.6, 107.2, 78.2, 67.3, 65.6, 56.3, 54.9, 52.4, 37.4, 29.0, 18.4, −1.24; IR (ATR, CHCl$_3$) 2957, 1763, 1685, 1644, 1606, 1516, 1457, 1434, 1360, 1247, 1209, 1098, 1066, 1023 cm$^{-1}$; MS (ES$^+$) m/z (relative intensity) 881 ([M+29]$^+$., 38), 853 ([M+H]$^+$., 100), 707 (8), 542 (12); HRMS [M+H]$^+$. theoretical C$_{41}$H$_{56}$N$_4$O$_{12}$Si$_2$ m/z 853.3506. found (ES$^+$) m/z 853.3502.

(j) 1,1′-[[(Propane-1,3-diyl)dioxy]bis(11aS)-7-methoxy-2-[[(trifluoromethyl)sulfonyl]oxy]-10-((2-(trimethylsilyl)ethoxy)methyl)-1,10,11,11a-tetra-hydro-5H-pyrrolo[2,1-c][1,4]-benzodiazepin-5,11-dione](12)

Anhydrous 2,6-lutidine (5.15 mL, 4.74 g, 44.2 mmol) was injected in one portion to a vigorously stirred solution of bis-ketone 11 (6.08 g, 7.1 mmol) in dry DCM (180 mL) at −45° C. (dry ice/acetonitrile) under a nitrogen atmosphere. Anhydrous triflic anhydride, taken from a freshly opened ampoule (7.2 mL, 12.08 g, 42.8 mmol), was injected rapidly dropwise, while maintaining the temperature at −40° C. or below. The reaction mixture was allowed to stir at −45° C. for 1 hour at which point TLC (50/50 v/v n-hexane/EtOAc) revealed the complete consumption of starting material. The cold reaction mixture was immediately diluted with DCM (200 mL) and, with vigorous shaking, washed with water (1×100 mL), 5% citric acid solution (1×200 mL) saturated NaHCO$_3$ (200 mL), brine (100 mL) and dried (MgSO$_4$). Filtration and evaporation of the solvent under reduced pressure afforded the crude product which was purified by flash column chromatography (gradient elution: 90:10 v/v n-hexane/EtOAc to 70:30 v/v n-hexane/EtOAc) to afford bis-enol triflate 12 as a yellow foam (5.5 g, 70%). LC/MS 4.32 min (ES+) m/z (relative intensity) 1139 ([M+Na]$^+$., 20); [α]$^{24}_D$=+271° (c=0.18, CHCl$_3$); $^1$H NMR (400 MHz, CDCl$_3$) δ 7.33 (s, 2H), 7.26 (s, 2H), 7.14 (t, 2H, J=1.97 Hz), 5.51 (d, 2H, J=10.1 Hz), 4.76 (d, 2H, J=10.1 Hz), 4.62 (dd, 2H, J=11.0, 3.69 Hz), 4.32-4.23 (m, 4H), 3.94-3.90 (m, 8H), 3.81-3.64 (m, 4H), 3.16 (ddd, 2H, J=16.3, 11.0, 2.36 Hz), 2.43 (p, 2H, J=5.85 Hz), 1.23-0.92 (m, 4H), 0.02 (s, 18H); $^{13}$C NMR (100 MHz, CDCl$_3$) δ 167.1, 162.7, 151.9, 148.0, 138.4, 133.6, 120.2, 118.8, 111.9, 107.4, 78.6, 67.5, 65.6, 56.7, 56.3, 30.8, 29.0, 18.4, −1.25; IR (ATR, CHCl$_3$) 2958, 1690, 1646, 1605, 1517, 1456, 1428, 1360, 1327, 1207, 1136, 1096, 1060, 1022, 938, 913 cm$^{-1}$; MS (ES$^+$) m/z (relative intensity) 1144 ([M+28]$^+$., 100), 1117 ([M+H]$^+$., 48), 1041 (40), 578 (8); HRMS [M+H]$^+$. theoretical C$_{43}$H$_{54}$N$_4$O$_{16}$Si$_2$S$_2$F$_6$ m/z 1117.2491. found (ES$^+$) m/z 1117.2465.

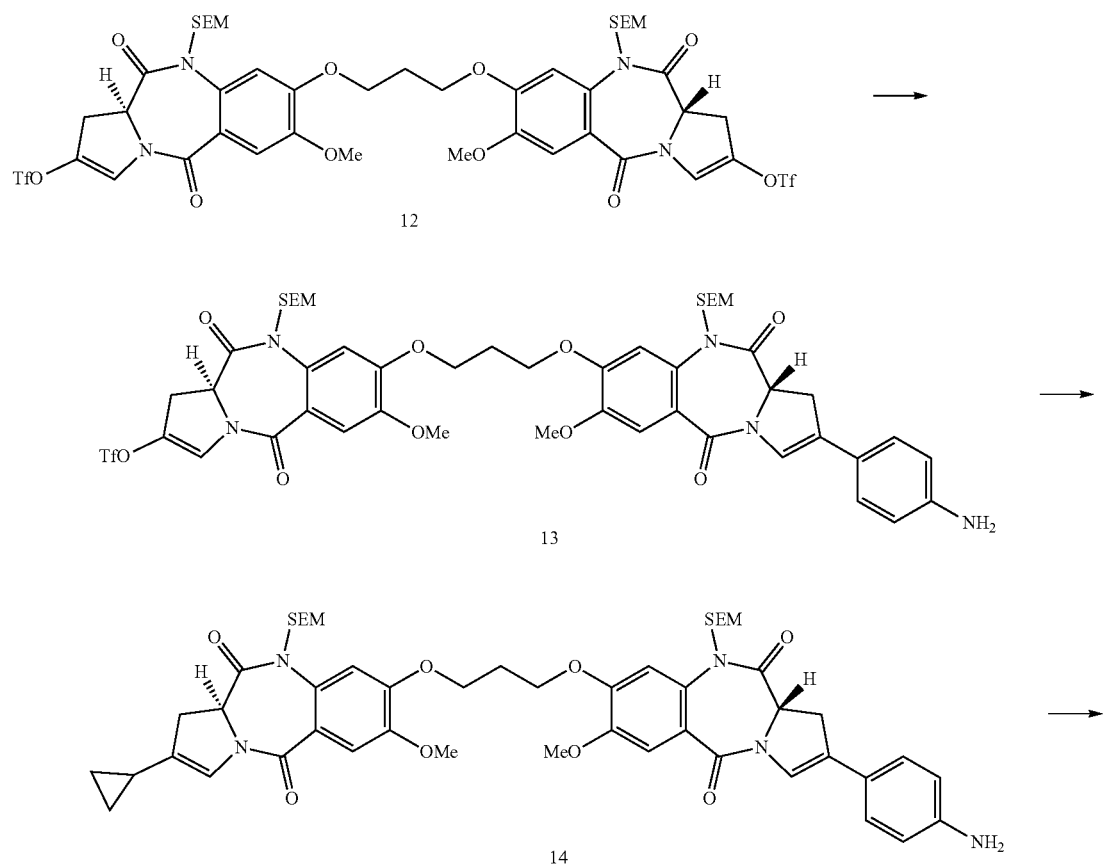

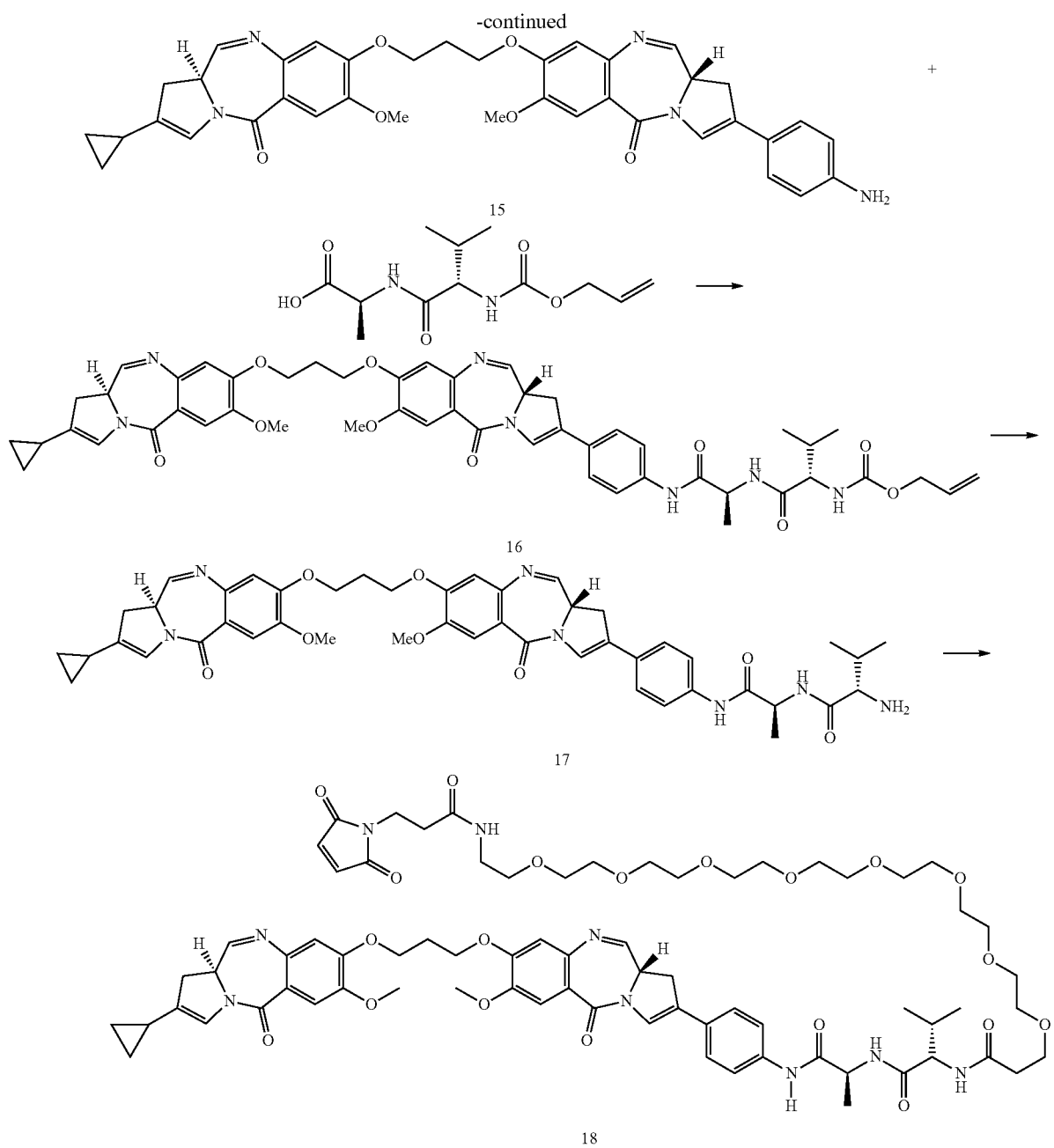

(a) (S)-8-(3-(((S)-2-(4-aminophenyl)-7-methoxy-5,11-dioxo-10-((2-(trimethylsilyl)ethoxy)methyl)-5,10,11,11a-tetrahydro-H-benzo[e]pyrrolo[1,2-a][1,4]diazepin-8-yl)oxy) propoxy)-7-methoxy-5,11-dioxo-10-((2-(trimethylsilyl)ethoxy)methyl)-5,10,11,11a-tetrahydro-H-benzo[e]pyrrolo[1,2-a][1,4]diazepin-2-yl trifluoromethanesulfonate (13)

Pd(PPh$_3$)$_4$ (116.9 mg, 0.101 mmol) was added to a stirred mixture of the bis-enol triflate 12 (5.65 g, 5.06 mmol), 4-Aminophenylboronic acid pinacol ester (1 g, 4.56 mmol), Na$_2$CO$_3$ (2.46 g, 23.2 mmol), MeOH (37 mL), toluene (74 mL) and water (37 mL). The reaction mixture was allowed to stir at 30° C. under a nitrogen atmosphere for 24 hours after which time all the boronic ester has consumed. The reaction mixture was then evaporated to dryness before the residue was taken up in EtOAc (150 mL) and washed with H$_2$O (2×100 mL), brine (150 mL), dried (MgSO$_4$), filtered and evaporated under reduced pressure to provide the crude product. Purification by flash chromatography (gradient elution: 80:20 v/v Hexane/EtOAc to 60:40 v/v Hexane/EtOAc) afforded product 13 as a yellowish foam (2.4 g, 45%). LC/MS 4.02 min (ES+) m/z (relative intensity) 1060.21 ([M+H]$^+$., 100); $^1$H-NMR: (CDCl$_3$, 400 MHz) δ 7.40 (s, 1H), 7.33 (s, 1H), 7.27 (bs, 3H), 7.24 (d, 2H, J=8.5 Hz), 7.15 (t, 1H, J=2.0 Hz), 6.66 (d, 2H, J=8.5 Hz), 5.52 (d, 2H, J=10.0 Hz), 4.77 (d, 1H, J=10.0 Hz), 4.76 (d, 1H, J=10.0 Hz), 4.62 (dd, 1H, J=3.7, 11.0 Hz), 4.58 (dd, 1H, J=3.4, 10.6 Hz), 4.29 (t, 4H, J=5.6 Hz), 4.00-3.85 (m, 8H), 3.80-3.60 (m, 4H), 3.16 (ddd, 1H, J=2.4, 11.0, 16.3 Hz), 3.11 (ddd, 1H, J=2.2, 10.5, 16.1 Hz), 2.43 (p, 2H, J=5.9 Hz), 1.1-0.9 (m, 4H), 0.2 (s, 18H). $^{13}$C-NMR: (CDCl$_3$, 100 MHz) δ 169.8, 168.3, 164.0, 162.7, 153.3, 152.6, 149.28, 149.0, 147.6, 139.6, 134.8, 134.5, 127.9, 127.5, 125.1, 123.21, 121.5, 120.5, 120.1, 116.4, 113.2, 108.7, 79.8, 79.6, 68.7, 68.5, 67.0, 66.8, 58.8, 58.0, 57.6, 32.8, 32.0, 30.3, 19.7, 0.25.

(b) (S)-2-(4-Aminophenyl)-8-(3-(((S)-2-cyclopropyl-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)propoxy)-7-methoxy-10-((2-(trimethylsilyl)ethoxy)methyl)-1H-benzo[e]pyrrolo[1,2-a][1,4]diazepine-5,11(10H, 11aH)-dione (14)

Triphenylarsine (0.24 g, 0.8 mmol), silver (I) oxide (1.02 g, 4.4 mmol), cyclopropylboronic acid (0.47 g, 5.5 mmol) and starting material 13 (1.15 g, 1.1 mmol) were dissolved in dioxane (30 mL) under an argon atmosphere. Potassium phosphate tribasic (2.8 g, 13.2 mmol) was ground-up with a pestle and mortar and quickly added to the reaction mixture. The reaction mixture was evacuated and flushed with argon 3 times and heated to 71° C. Palladium (II) bis (benzonitrile chloride) (84 mg, 0.22 mmol) was added and the reaction vessel was evacuated and flushed with argon 3 times. After 10 minutes a small sample was taken for analysis by TLC (80:20 v/v ethyl acetate/hexane) and LC/MS. After 30 minutes the reaction had gone to completion (LC/MS analysis indicated complete consumption of starting material) and the reaction was filtered through celite and the filter pad washed with ethyl acetate (400 mL). The filtrate was washed with water (2×200 mL) and brine (2×200 mL). The organic layer was dried with MgSO$_4$, filtered and the solvent removed in vacuo. Purification by silica gel column chromatography (30:70 v/v Hexane/Ethyl acetate) afforded the product 14 as an orangey/yellow solid (0.66 g, 63%). Method 1, LC/MS (3.85 min (ES$^+$) m/z (relative intensity) 952.17 ([M+H]$^+$., 100). $^1$H NMR (400 MHz, CDCl$_3$) δ 7.36 (d, 2H, J=8.4 Hz), 7.30 (s, 1H), 7.25-7.19 (m, 4H), 6.68 (s, 1H), 6.62 (d, 2H, J=8.4 Hz), 5.49 (dd, 2H, J=5.6, 10.0 Hz), 4.73 (app. t, 2H, J=10.8 Hz), 4.54 (dd, 1H, J=3.2, 10.4 Hz), 4.40 (dd, 1H, J=3.2, 10.4 Hz), 4.29-4.23 (m, 4H), 3.91-3.85 (m, 7H), 3.80-3.71 (m, 2H), 3.70-3.61 (m, 2H), 3.38-3.32 (m, 1H), 3.12-3.01 (m, 1H), 2.50-2.69 (m, 1H), 2.40 (q, 2H, J=5.6 Hz), 1.50-1.43 (m, 1H), 0.99-0.71 (m, 6H), 0.54-0.59 (m, 2H), 0.00 (s, 18H) ppm.

(c) (S)-2-(4-Aminophenyl)-8-(3-(((S)-2-cyclopropyl-7-methoxy-5-oxo-5,11a-dihydro-1H-benzo[e]pyrrolo[1,2-a][1,4]diazepin-8-yl)oxy)propoxy)-7-methoxy-1H-benzo[e]pyrrolo[1,2-a][1,4]diazepin-5(11aH)-one (15)

SEM dilactam 14 (0.66 g, 0.69 mmol) was dissolved in THF (23 mL) and cooled to −78° C. under an argon atmosphere. Super-Hydride® solution (1.7 mL, 1 M in THF) was added drop wise over 5 minutes while monitoring the temperature. After 20 minutes a small sample was taken and washed with water for LC/MS analysis. Water (50 mL) was added and the cold bath was removed. The organic layer was extracted and washed with brine (60 mL). The combined aqueous layers were washed with CH$_2$Cl$_2$/MeOH (90/10 v/v) (2×50 mL). The combined organic layers were dried with MgSO$_4$, filtered and the solvent removed in vacuo. The crude product was dissolved in MeOH (48 mL), CH$_2$Cl$_2$ (18 mL) and water (6 mL) and sufficient silica gel was added to afford a thick suspension. After 5 days stirring, the suspension was filtered through a sintered funnel and washed with CH$_2$Cl$_2$/MeOH (9:1) (~200 mL) until product ceased to be eluted. The organic layer was washed with brine (2×70 mL), dried with MgSO$_4$, filtered and the solvent removed in vacuo. Purification by silica gel column chromatography (100% CHCl$_3$ to 96/4 v/v CHCl$_3$/MeOH) afforded the product 15 as a yellow solid (302 mg, 66%). Method 1, LC/MS (2.42 min (ES$^+$) m/z (relative intensity) 660.74 ([M+H]$^+$., 30). $^1$H NMR (400 MHz, CDCl$_3$) δ 7.86 (d, 1H, J=3.6 Hz), 7.78 (d, 1H, J=3.6 Hz), 7.58-7.44 (m, 3H), 7.34-7.20 (m, 3H), 6.88-6.66 (m, 4H), 4.35-4.15 (m, 6H), 3.95-3.75 (m, 7H), 3.39-3.22 (m, 1H), 3.14-3.04 (m, 1H), 2.93-2.85 (m, 1H), 2.46-2.36 (m, 2H), 1.49-1.41 (m, 1H), 0.80-0.72 (m, 2H), 0.58-0.51 (app. s, 2H) ppm.

(d) Allyl ((2S)-1-(((2S)-1-((4-(8-(3-((2-cyclopropyl-7-methoxy-5-oxo-5,11a-dihydro-1H-benzo[e]pyrrolo[1,2-a][1,4]diazepin-8-yl)oxy)propoxy)-7-methoxy-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)carbamate (16)

In a degassed round bottom flask filled with argon, HO-Ala-Val-alloc (149.6 mg, 0.549 mmol) and EEDQ (135.8 mg, 0.549 mmol) were dissolved in a 9:1 mixture of dry CH$_2$Cl$_2$/MeOH (5 mL). The flask was wrapped in aluminium foil and the reaction mixture was allowed to stir at room temperature for 1 hour before starting material 15 (302 mg, 0.457 mmol) was added. The reaction mixture was left to stir for a further 40 hours at room temperature before the volatiles were removed by rotary evaporation under reduced pressure (the reaction was followed by LC/MS, RT starting material 2.32 min, (ES$^+$660.29 ([M+H]$^+$., 100)). The crude product was directly purified by silica gel chromatography column (100% CHCl$_3$ to 90/10 v/v CHCl$_3$/MeOH) to afford the pure product (16) in 42% yield (174 mg). Method 2 LC/MS (2.70 min (ES+) m/z (relative intensity) 914.73 ([M+H]$^+$., 60), 660.43 (60), 184.31 (100)).

(e) (2S)-2-amino-N-((2S)-1-((4-(8-(3-((2-cyclopropyl-7-methoxy-5-oxo-5,11a-dihydro-1H-benzo[e]pyrrolo[1,2-a][1,4]diazepin-8-yl)oxy)propoxy)-7-methoxy-5-oxo-5,11a-dihydro-1H-benzo[e]pyrrolo[1,2-a][1,4]diazepin-2-yl)phenyl)amino)-1-oxopropan-2-yl)-3-methylbutanamide (17)

The starting material 16 (170 mg, 0.185 mmol) was dissolved in dry CH$_2$Cl$_2$ (5 mL) in a round bottom flask filled with argon, before pyrrolidine (41 μL, 0.21 mmol) was added. The flask was purged/refilled three times with argon before Pd(PPh$_3$)$_4$ (14 mg, 0.084 mmol) was added and the flushing operation repeated. After 1 hour, complete consumption of starting material was observed (the reaction was followed by LC/MS) and Et$_2$O (50 mL) was added to the reaction mixture which was allowed to stir until all the product had crashed out of solution. The solid was filtered through a sintered funnel and washed twice with Et$_2$O (2×25 mL). The collecting flask was replaced and the isolated solid was dissolved in CHCl$_3$ (100 mL or until all the product had passed through the sintered funnel). The volatiles were then removed by rotary evaporation under reduced pressure to afford the crude product 17 which was used directly in the next step (168 mg). LC/MS method 2 (2.70 min (ES+) m/z (relative intensity) 830.27 ([M+H]$^+$., 50), 660.13 (80), 171.15 (100)).

(f) N—((R)-1-(((S)-1-((4-((S)-8-(3-(((S)-2-cyclopropyl-7-methoxy-5-oxo-5,11a-dihydro-1H-benzo[e]pyrrolo[1,2-a][1,4]diazepin-8-yl)oxy)propoxy)-7-methoxy-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)-1-(3-(2,5-dioxo-2,5-dihydro-1H-pyrrol-1-yl)propanamido)-3,6,9,12,15,18,21,24-octaoxaheptacosan-27-amide (18 or DL1)

Starting material 17 (154 mg, 0.185 mmol) and EDCI·HCl (110 mg, 0.185 mmol) were solubilised in dry $CH_2Cl_2$ (5 mL) in a round bottom flask purged and filled with argon. The mixture was left to stir at room temperature for 1 hour before PEGs-maleimide (35.6 mg, 0.185 mmol) was added and the reaction mixture stirred for a further 16 hours (or until the reaction is complete, monitored by LC/MS). The reaction solution was diluted with $CH_2Cl_2$ (50 mL) and the organics were washed with $H_2O$ (50 mL) and brine (50 mL) before being dried with $MgSO_4$, filtered and the solvent removed by rotary evaporation under reduced pressure to afford the crude product. Purification on silica gel column chromatography (100% $CHCl_3$ to 85/15 v/v $CHCl_3$/MeOH) gave the desired product (135 mg), however remaining traces of unreacted PEGs-maleimide were observed (by LC/MS, 2.21 min, method 2). Automated reverse phase silica gel chromatography ($H_2O/CH_3CN$) (see general information for conditions) successfully removed the impurity affording pure final product (18, 37 mg of pure product starting from 110 mg, 33%). Overall yield=17%. Method 2 LC/MS (2.58 min (ES+) m/z (relative intensity) 1404.03 ([M+H]$^+$., 20), 702.63 (100)). $^1$H NMR (400 MHz, $CDCl_3$) δ 7.91 (t, J=3.5 Hz, 1H), 7.80 (d, J=4.0 Hz, 1H), 7.75 (d, J=8.8 Hz, 1H), 7.69 (d, J=8.7 Hz, 1H), 7.54-7.50 (m, 2H), 7.45 (s, 1H), 7.39-7.31 (m, 2H), 6.87 (d, J=10.5 Hz, 2H), 6.76 (s, 1H), 6.72-6.68 (m, 2H), 4.74-4.62 (m, 1H), 4.45-4.17 (m, 7H), 3.95 (s, 3H), 3.94 (s, 3H), 3.67-3.58 (m, 34H), 3.54 (m, 2H), 3.42 (dd, J=10.2, 5.2 Hz, 2H), 3.16-3.07 (m, 1H), 2.92 (dd, J=16.1, 4.1 Hz, 1H), 2.62-2.49 (m, 4H), 2.48-2.39 (m, 2H), 2.37-2.25 (m, 1H), 1.92 (s, 1H), 1.52-1.44 (m, 3H), 1.10-0.93 (m, 6H), 0.79 (dd, J=9.2, 5.3 Hz, 2H), 0.57 (dd, J=9.2, 5.3 Hz, 2H), NH were not observed.

C. Synthesis of Drug-Linker DL1 (Route 2)

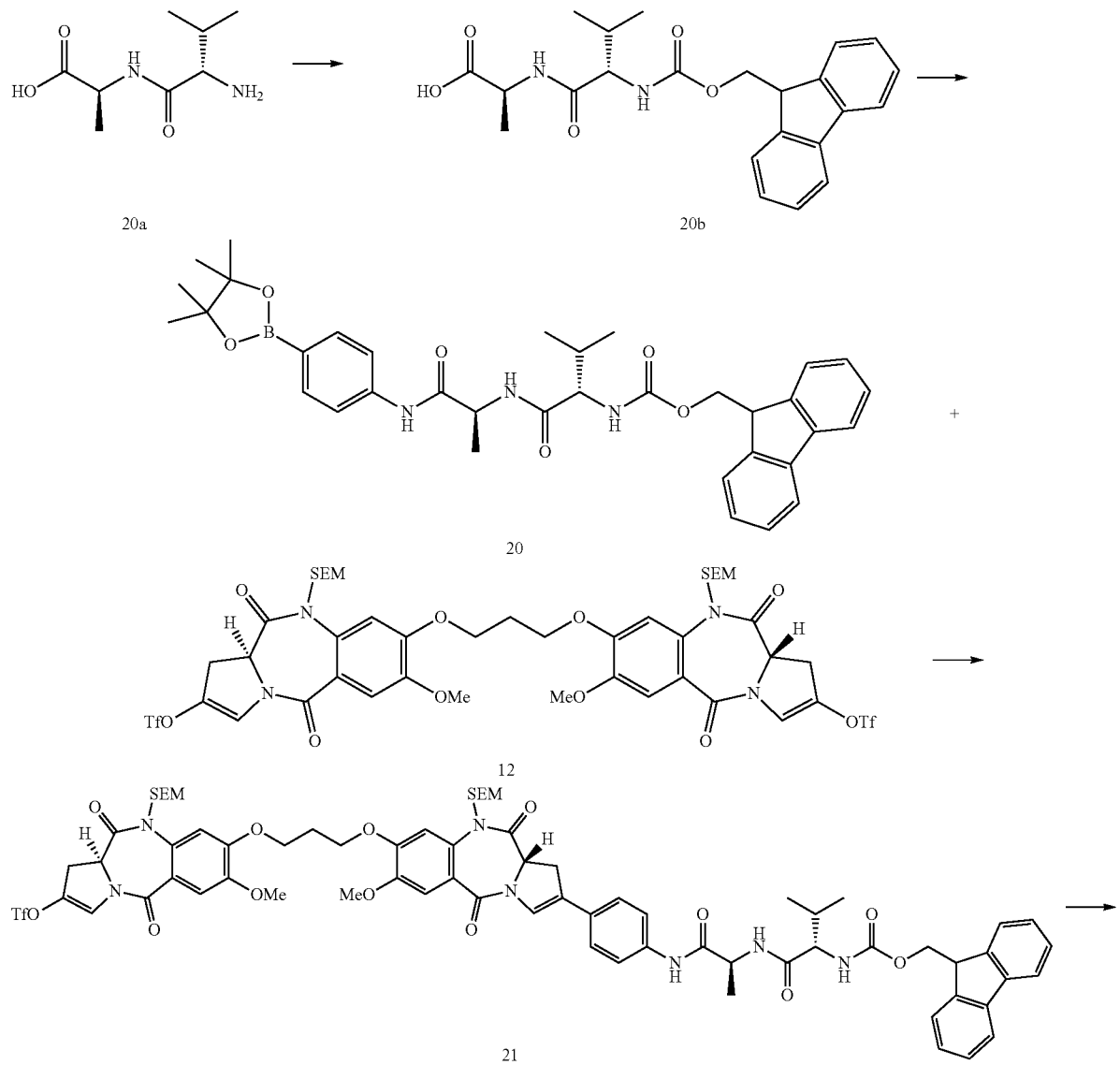

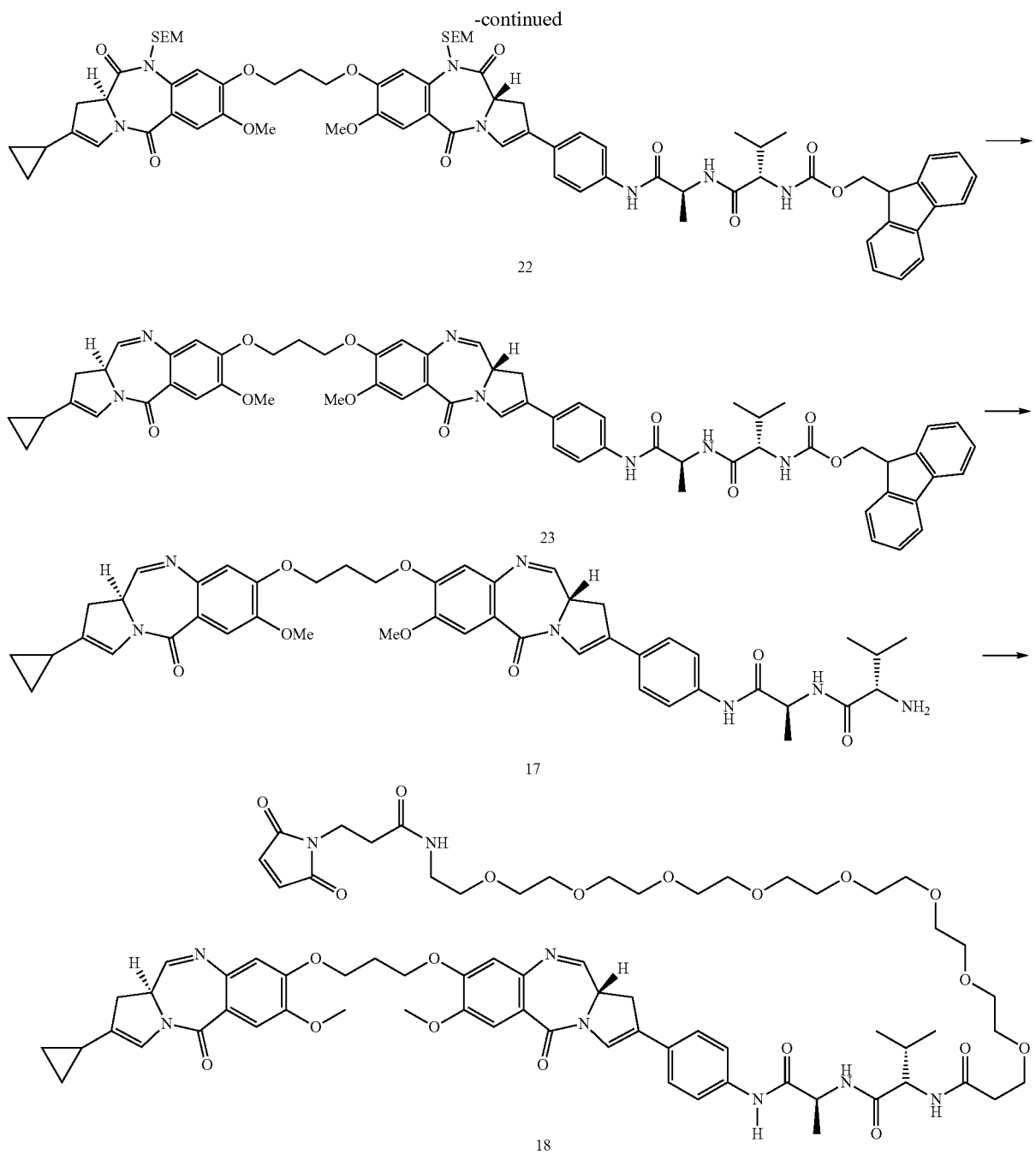

(a) (R)-2-((R)-2-((((9H-fluoren-9-yl)methoxy)carbonyl)amino)-3-methylbutanamido) propanoic acid (20b)

HO-Ala-Val-H 20a (350 mg, 1.86 mmol) and Na₂CO₃ (493 mg, 4.65 mmol) were dissolved in distilled H₂O (15 mL) and the mixture was cooled to 0° C. before dioxane (15 mL) was added (partial precipitation of the amino acid salt occurred). A solution of Fmoc-Cl (504 mg, 1.95 mmol) in dioxane (15 mL) was added dropwise with vigorous stirring over 10 minutes. The resulting mixture was stirred at 0° C. for 2 hours before the ice bath was removed and stirring was maintained for 16 hours. The solvent was removed by rotary evaporation under reduced pressure and the residue dissolved in water (150 mL). The pH was adjusted from 9 to 2 with 1N HCl and the aqueous layer was subsequently extracted with EtOAc (3×100 mL). The combined organics were washed with brine (100 mL), dried with MgSO₄, filtered and the volatiles removed by rotary evaporation under reduced pressure to afford pure HO-Ala-Val-Fmoc 20b (746 mg, 97% yield). LC/MS 2.85 min (ES+) m/z (relative intensity) 410.60; ¹H-NMR (400 MHz, CDCl₃) δ 7.79 (d, J=7.77 Hz, 2H), 7.60 (d, J=7.77 Hz, 2H), 7.43 (d, J=7.5 Hz, 2H), 7.34 (d, J=7.5 Hz, 2H), 6.30 (bs, 1H), 5.30 (bs, 1H), 4.71-7.56 (m, 1H), 4.54-4.36 (m, 2H), 4.08-3.91 (m, 1H), 2.21-2.07 (m, 1H), 1.50 (d, J=7.1 Hz, 3H), 1.06-0.90 (m, 6H).

(b) (9H-fluoren-9-yl)methyl ((S)-3-methyl-1-oxo-1-(((S)-1-oxo-1-((4-(4,4,5,5-tetramethyl-1,3,2-dioxaborolan-2-yl)phenyl) propan-2-yl)amino)propan-2-yl)amino)butan-2-yl)carbamate (20)

4-Aminophenylboronic acid pinacol ester was added (146.9 mg, 0.67 mmol) was added to a solution of HO-Ala-Val-Fmoc 20b (330 mg, 0.8 mmol), DCC (166 mg, 0.8 mmol) and DMAP (5 mg, cat.) in dry DCM (8 mL) previously stirred for 30 minutes at room temperature in a flask flushed with argon. The reaction mixture was then allowed to stir at room temperature overnight. The reaction was followed by LCMS and TLC. The reaction mixture was diluted with $CH_2Cl_2$ and the organics were washed with $H_2O$ and brine before being dried with $MgSO_4$, filtered and the solvent removed by rotary evaporation under reduced pressure. The crude product was dryloaded on a silicagel chromatography column (Hexane/EtOAc, 6:4) and pure product 20 was isolated as a white solid in 88% yield (360 mg).

(c) 8-(3-((2-(4-((S)-2-((S)-2-((((9H-fluoren-9-yl)methoxy)carbonyl)amino)-3-methylbutanamido) propanamido)phenyl)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-8-yl)oxy)propoxy)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-2-yl trifluoromethanesulfonate (21)

Bis-triflate 12 (2.03 g, 1.81 mmol), boronic pinacol ester (Ig, 1.63 mmol) and $Na_2CO_3$ (881 mg, 8.31 mmol) were dissolved in a mixture of toluene/MeOH/$H_2O$, 2:1:1 (40 mL). The reaction flask was purged and filled with argon three times before tetrakis(triphenylphosphine)palladium(0) (41 mg, 0.035 mmol) was added and the reaction mixture heated to 30° C. overnight. The solvents were removed under reduce pressure and the residue was taken up in $H_2O$ (100 mL) and extracted with EtOAc (3×100 mL). The combined organics were washed with brine (100 mL), dried with $MgSO_4$, filtered and the volatiles removed by rotary evaporation under reduced pressure. The crude product was purified by silica gel chromatography column (Hexane/EtOAc, 8:2 to 25:75) to afford pure 21 in 33% yield (885 mg). LC/MS 3.85 min (ES+) m/z (relative intensity) 1452.90; $^1$H NMR (400 MHz, CDCl$_3$) δ 7.78-7.16 (m, 17H), 7.13 (s, 1H), 6.51-6.24 (m, 1H), 5.51 (dd, J=10.0, 5.1 Hz, 2H), 5.36-5.11 (m, 1H), 4.74 (dd, J=10.1, 4.4 Hz, 2H), 4.70-4.53 (m, 2H), 4.47 (d, J=6.4 Hz, 1H), 4.37 (d, J=7.2 Hz, 1H), 4.27 (m, 4H), 4.20-4.14 (m, 1H), 3.90 (s, 3H), 3.89 (s, 3H), 3.77 (ddd, J=16.7, 9.0, 6.4 Hz, 3H), 3.71-3.61 (m, 2H), 3.24-2.91 (m, 3H), 2.55-2.33 (m, 2H), 2.22-2.07 (m, 1H), 1.52-1.37 (m, 3H), 1.04-0.86 (m, 10H), 0.00 (s, 18H).

(d) (9H-fluoren-9-yl)methyl((2S)-1-(((2S)-1-((4-(8-(3-((2-cyclopropyl-7-methoxy-5,11-dioxo-10-((2-(trimethylsilyl) ethoxy)methyl)-5,10,11,11a-tetrahydro-1H-benzo[e]pyrrolo[1,2-a][1,4]diazepin-8-yl)oxy)propoxy)-7-methoxy-5,11-dioxo-10-((2-(trimethylsilyl)ethoxy)methyl)-5,10,11,11a-tetrahydro-1H-benzo[e]pyrrolo[1,2-a][1,4]diazepin-2-yl)phenyl)amino)-1-oxopropan-2-yl)amino)-3-methyl-1-oxobutan-2-yl)carbamate (22)

Triphenylarsine (42 mg, 0.137 mmol) was added to a mixture of PBD-triflate 21 (250 mg, 0.172 mmol), cyclopropylboronic acid (73.9 mg, 0.86 mmol), silver oxide (159 mg, 0.688 mmol) and potassium phosphate tribasic (438 mg, 2.06 mmol) in dry dioxane (10 mL) under an argon atmosphere. The reaction was flushed with argon 3 times and bis(benzonitrile)palladium(II) chloride (13.2 mg, 0.034 mmol) was added. The reaction was flushed with Argon 3 more times before being warmed to 75° C. and stirred for 10 minutes. The reaction mixture was filtered through a pad of celite which was subsequently rinsed with ethyl acetate. The solvent was removed by rotary evaporation under reduced pressure. The resulting residue was subjected to flash column chromatography (silica gel; 1% methanol/chloroform). Pure fractions were collected and combined, and excess eluent was removed by rotary evaporation under reduced pressure to afford the desired product 22 (132 mg, 50% yield). LC/MS 3.83 min (ES+) m/z (relative intensity) 1345.91; 1H NMR (400 MHz, CDCl$_3$) δ 7.88-7.14 (m, 17H), 6.69 (s, 1H), 6.45-6.25 (m, 1H), 5.57-5.41 (m, 2H), 5.34-5.14 (m, 1H), 4.78-4.67 (m, 2H), 4.62-4.55 (m, 1H), 4.50-4.45 (m, 2H), 4.51-4.44 (m, 1H), 4.31-4.21 (m, 4H), 4.16 (m, 1H), 3.92 (s, 3H), 3.86 (s, 3H), 3.82-3.71 (m, 2H), 3.66 (m, 3H), 3.40-3.28 (m, 1H), 3.07 (m, 1H), 2.70-2.57 (m, 1H), 2.47-2.36 (m, 2H), 2.15 (m, 1H), 1.51-1.40 (m, 3H), 1.03-0.87 (m, 11H), 0.77-0.71 (m, 2H), 0.60-0.54 (m, 2H), 0.00 (t, J=3.0 Hz, 18H).

(e) (9H-fluoren-9-yl)methyl((2S)-1-(((2S)-1-((4-(8-(3-((2-cyclopropyl-7-methoxy-5-oxo-5,11a-dihydro-1H-benzo[e]pyrrolo[1,2-a][1,4]diazepin-8-yl)oxy)propoxy)-7-mnethoxy-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)carbamate (23)

A solution of Super-Hydride® (0.5 mL, 1M in THF) was added dropwise to a solution of SEM dilactam 22 (265 mg g, 0.19 mmol) in THF (10 mL) at −78° C. under an argon atmosphere. The addition was completed over 5 minutes in order to maintain the internal temperature of the reaction mixture constant. After 20 minutes, an aliquot was quenched with water for LC/MS analysis, which revealed that the reaction was complete. Water (20 mL) was added to the reaction mixture and the cold bath was removed. The organic layer was extracted with EtOAc (3×30 mL) and the combined organics were washed with brine (50 mL), dried with $MgSO_4$, filtered and the solvent removed by rotary evaporation under reduced pressure. The crude product was dissolved in MeOH (12 mL), $CH_2Cl_2$ (6 mL), water (2 mL) and enough silica gel to form a thick stirring suspension. After 5 days, the suspension was filtered through a sintered funnel and washed with $CH_2Cl_2$/MeOH (9:1) (200 mL) until the elution of the product was complete. The organic layer was washed with brine (2×70 mL), dried with $MgSO_4$, filtered and the solvent removed by rotary evaporation under reduced pressure. Purification by silica gel column chromatography (100% CHCl$_3$ to 96% CHCl$_3$/4% MeOH) afforded the product 23 as a yellow solid (162 mg, 78%). LC/MS 3.02 min (ES+) m/z (relative intensity) 1052.37.

(f) (2S)-2-amino-N-((2S)-1-((4-(8-(3-((2-cyclopropyl-7-methoxy-5-oxo-5,11a-dihydro-1H-benzo[e]pyrrolo[1,2-a][1,4]diazepin-8-yl)oxy)propoxy)-7-methoxy-5-oxo-5,11a-dihydro-1H-benzo[e]pyrrolo[1,2-a][1,4]diazepin-2-yl)phenyl)amino)-1-oxopropan-2-yl)-3-methylbutanamide (17)

Excess piperidine was added (0.2 mL, 2 mmol) to a solution of SEM-dilactam 23 (76 mg, 0.073 mmol) in DMF (1 mL). The mixture was allowed to stir at room temperature for 20 min, at which point the reaction had gone to completion (as monitored by LC/MS). The reaction mixture was diluted with CH$_2$Cl$_2$ (75 mL) and the organic phase was washed with H$_2$O (3×75 mL) until complete piperidine removal. The organic phase was dried over MgSO$_4$, filtered and excess solvent removed by rotary evaporation under reduced pressure to afford crude product 17 which was used as such in the next step. LC/MS 2.32 min (ES+) m/z (relative intensity) 830.00.

(g) N-((2S)-1-(((2S)-1-((4-(8-(3-((2-cyclopropyl-7-methoxy-5-oxo-5,11a-dihydro-1H-benzo[e]pyrrolo[1,2-a][1,4]diazepin-8-yl)oxy)propoxy)-7-methoxy-5-oxo-5,11a-dihydro-1H-benzo[e]pyrrolo[1,2-a][1,4]diazepin-2-yl)phenyl)amino)-1-oxopropan-2-yl)amino)-3-methyl-1-oxobutan-2-yl)-1-(3-(2,5-dioxo-2,5-dihydro-1H-pyrrol-1-yl)propanamido)-3,6,9,12,15,18,21,24-octaoxaheptacosan-27-amide (18 or DL 1)

EDCI hydrochloride (14 mg, 0.0732 mmol) was added to a suspension of Maleimide-PEGs-acid (43.4 mg, 0.0732 mmol) in dry CH$_2$Cl$_2$ (5 mL) under argon atmosphere. The mixture was stirred for 1 hour at room temperature before PBD 17 (60.7 mg, 0.0732 mmol) was added. Stirring was maintained until the reaction was complete (usually 5 hours). The reaction was diluted with CH$_2$Cl$_2$ and the organic phase was washed with H$_2$O and brine before being dried over MgSO$_4$, filtered and excess solvent removed by rotary evaporation under reduced pressure by rotary evaporation under reduced pressure. The product was purified by careful silica gel chromatography (slow elution starting with 100% CHCl$_3$ up to 9:1 CHCl$_3$/MeOH) followed by reverse phase chromatography to remove unreacted maleimide-PEGs-acid. The product 18 (DL1) was isolated in 17.6% (21.8 mg). LC/MS 2.57 min (ES+) m/z (relative intensity) 1405.30; 1H NMR (400 MHz, CDCl$_3$) δ 7.91 (t, J=3.5 Hz, 1H), 7.80 (d, J=4.0 Hz, 1H), 7.75 (d, J=8.8 Hz, 1H), 7.69 (d, J=8.7 Hz, 1H), 7.54-7.50 (m, 2H), 7.45 (s, 1H), 7.39-7.31 (m, 2H), 6.87 (d, J=10.5 Hz, 2H), 6.76 (s, 1H), 6.72-6.68 (m, 2H), 4.74-4.62 (m, 1H), 4.45-4.17 (m, 7H), 3.95 (s, 3H), 3.94 (s, 3H), 3.67-3.58 (m, 34H), 3.54 (m, 2H), 3.42 (dd, J=10.2, 5.2 Hz, 2H), 3.16-3.07 (m, 1H), 2.92 (dd, J=16.1, 4.1 Hz, 1H), 2.62-2.49 (m, 4H), 2.48-2.39 (m, 2H), 2.37-2.25 (m, 1H), 1.92 (s, 1H), 1.52-1.44 (m, 3H), 1.10-0.93 (m, 6H), 0.79 (dd, J=9.2, 5.3 Hz, 2H), 0.57 (dd, J=9.2, 5.3 Hz, 2H), NH were not observed.

D. Synthesis of Drug-Linker DL2 (Route 1)

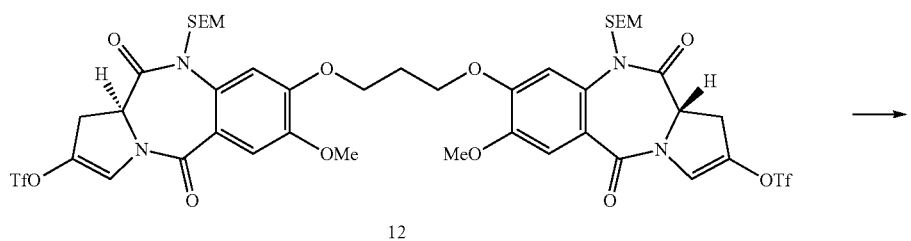

12

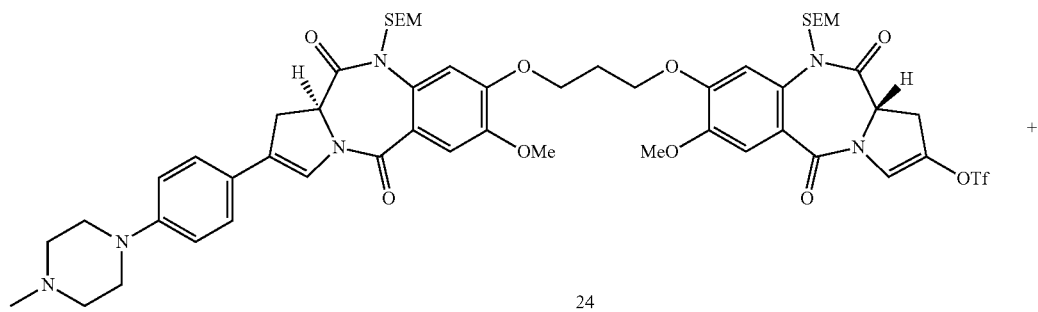

24

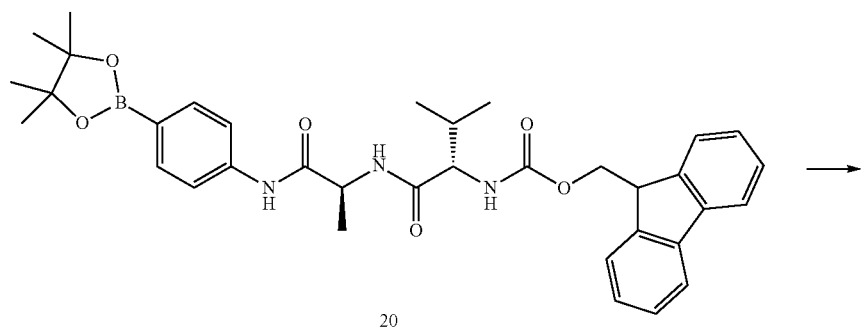

20

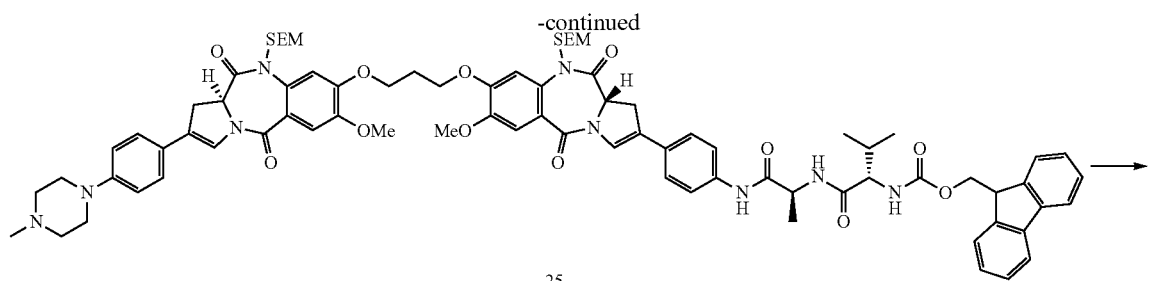

25

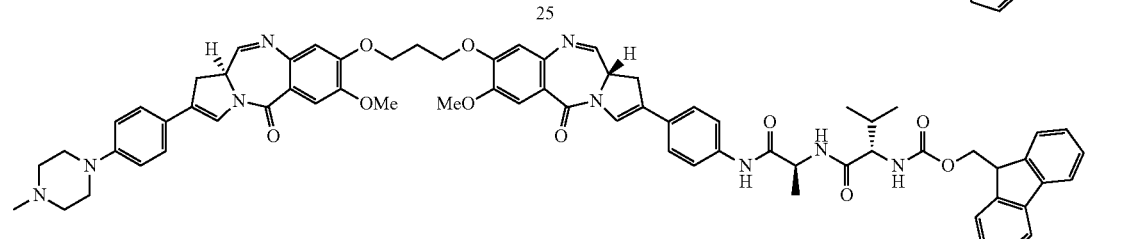

26

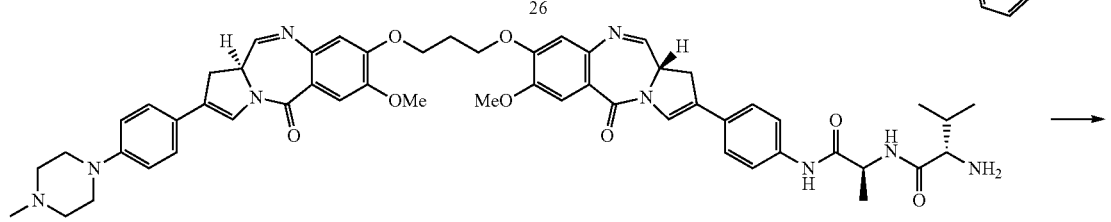

27

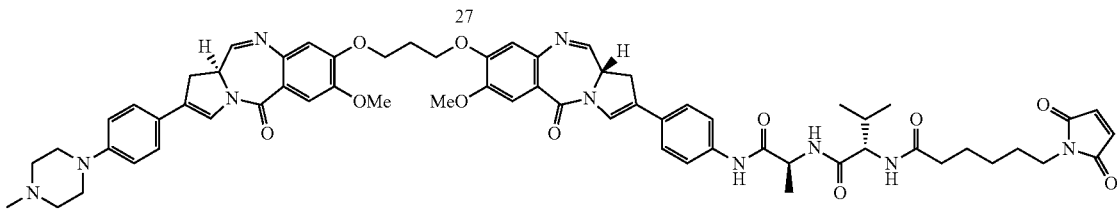

28

(a) (S)-7-methoxy-8-(3-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-pyrrolo[2,1-c][1,4]benzodiazepin-8-yl)oxy)propoxy)-5,11-dioxo-10-((2-(trimethylsilyl)ethoxy)methyl)-5,10,11,11a-tetrahydro-1H-pyrrolo[2,1-c][1,4]benzodiazepin-2-yl trifluoromethanesulfonate (24)

Pd(PPh₃)₄ (20.6 mg, 0.018 mmol) was added to a stirred mixture of the bis-enol triflate 12 (500 mg, 0.44 mmol), N-methyl piperazine boronic ester (100 mg, 0.4 mmol), Na₂CO₃ (218 mg, 2.05 mmol), MeOH (2.5 mL), toluene (5 mL) and water (2.5 mL). The reaction mixture was allowed to stir at 30° C. under a nitrogen atmosphere for 24 hours after which time all the boronic ester has consumed. The reaction mixture was then evaporated to dryness before the residue was taken up in EtOAc (100 mL) and washed with H₂O (2×50 mL), brine (50 mL), dried (MgSO₄), filtered and evaporated under reduced pressure to provide the crude product. Purification by flash chromatography (gradient elution: 80:20 v/v Hexane/EtOAc to 60:40 v/v Hexane/EtOAc) afforded product 24 as a yellowish foam (122.6 mg, 25%).

LC/MS 3.15 min (ES+) m/z (relative intensity) 1144 ([M+H]⁺., 20%).

(b) (9H-fluoren-9-yl)methyl ((S)-1-(((S)-1-((4-((S)-7-methoxy-8-(3-(((S)-7-methoxy-2-(4-(4-methylpiperazin-1-yl)phenyl)-5,11-dioxo-10-((2-(trimethylsilyl)ethoxy)methyl)-5,10,11,11a-tetrahydro-1H-pyrrolo[2,1-c][1,4]benzodiazepin-8-yl)oxy)propoxy)-5,11-dioxo-10-((2-(trimethylsilyl) ethoxy) methyl)-5,10,11,11a-tetrahydro-1H-pyrrolo[2,1-c][1,4]benzodiazepin-2-yl)phenyl)amino)-1-oxopropan-2-yl)amino)-3-methyl-1-oxobutan-2-yl)carbamate (25)

PBD-triflate 24 (359 mg, 0.314 mmol), boronic pinacol ester 20 (250 mg, 0.408 mmol) and triethylamine (0.35 mL, 2.51 mmol) were dissolved in a mixture of toluene/MeOH/H₂O, 2:1:1 (3 mL). The microwave vessel was purged and filled with argon three times before tetrakis(triphenylphosphine)palladium(0) (21.7 mg, 0.018 mmol) was added and the reaction mixture placed in the microwave at 80° C. for 10 minutes. Subsequently, CH₂Cl₂ (100 mL) was added and the organics were washed with water (2×50 mL) and brine (50 mL) before being dried with MgSO₄, filtered and the volatiles removed by rotary evaporation under reduced pressure. The crude product was purified by silica gel chromatography column (CHCl₃/MeOH, 100% to 9:1) to afford pure 25 (200 mg, 43% yield). LC/MS 3.27 min (ES+) m/z (relative intensity) 1478 ([M+H]⁺., 100%).

(c) (9H-fluoren-9-yl)methyl ((S)-1-(S)-1-((4-((S)-7-methoxy-8-(3-(((S)-7-methoxy-2-(4-(4-methylpiperazin-1-yl)phenyl)-5-oxo-5,11a-dihydro-1H-pyrrolo[2,1-c][1,4]benzodiazepin-8-yl)oxy)propoxy)-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)carbamate (26)

A solution of Super-Hydride® (0.34 mL, 1M in THF) was added dropwise to a solution of SEM-dilactam 25 (200 mg, 0.135 mmol) in THF (5 mL) at −78° C. under an argon atmosphere. The addition was completed over 5 minutes in order to maintain the internal temperature of the reaction mixture constant. After 20 minutes, an aliquot was quenched with water for LC/MS analysis, which revealed that the reaction was complete. Water (20 mL) was added to the reaction mixture and the cold bath was removed. The organic layer was extracted with EtOAc (3×30 mL) and the combined organics were washed with brine (50 mL), dried with MgSO$_4$, filtered and the solvent removed by rotary evaporation under reduced pressure. The crude product was dissolved in MeOH (6 mL), CH$_2$Cl$_2$ (3 mL), water (1 mL) and enough silica gel to form a thick stirring suspension. After 5 days, the suspension was filtered through a sintered funnel and washed with CH$_2$Cl$_2$/MeOH (9:1) (100 mL) until the elution of the product was complete. The organic layer was washed with brine (2×50 mL), dried with MgSO$_4$, filtered and the solvent removed by rotary evaporation under reduced pressure. Purification by silica gel column chromatography (100% CHCl$_3$ to 96% CHCl$_3$/4% MeOH) afforded the product 26 as a yellow solid (100 mg, 63%). LC/MS 2.67 min (ES+) m/z (relative intensity) 1186 ([M+H]$^+$., 5%).

(d) (S)-2-amino-N—((S)-1-((4-((R)-7-methoxy-8-(3-(((R)-7-methoxy-2-(4-(4-methylpiperazin-1-yl)phenyl)-5-oxo-5,11a-dihydro-1H-pyrrolo[2,1-c][1,4]benzodiazepin-8-yl)oxy)propoxy)-5-oxo-5,11a-dihydro-1H-pyrrolo[2,1-c][1,4]benzodiazepin-2-yl)phenyl)amino)-1-oxopropan-2-yl)-3-methylbutanamide (27)

Excess piperidine was added (0.1 mL, 1 mmol) to a solution of PBD 26 (36.4 mg, 0.03 mmol) in DMF (0.9 mL). The mixture was allowed to stir at room temperature for 20 min, at which point the reaction had gone to completion (as monitored by LC/MS). The reaction mixture was diluted with CH$_2$Cl$_2$ (50 mL) and the organic phase was washed with H$_2$O (3×50 mL) until complete piperidine removal. The organic phase was dried over MgSO$_4$, filtered and excess solvent removed by rotary evaporation under reduced pressure to afford crude product 27 which was used as such in the next step. LC/MS 2.20 min (ES+) m/z (relative intensity) 964 ([M+H]$^+$., 5%).

(e) 6-(2,5-dioxo-2,5-dihydro-1H-pyrrol-1-yl)-N—((S)-1-(((S)-1-((4-((S)-7-methoxy-8-(3-(((S)-7-methoxy-2-(4-(4-methylpiperazin-1-yl)phenyl)-5-oxo-5,11a-dihydro-1H-pyrrolo[2,1-c][1,4]benzodiazepin-8-yl)oxy)propoxy)-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)hexanamide (28 or DL 2)

EDCI hydrochloride (4.7 mg, 0.03 mmol) was added to a suspension of 6-maleimidohexanoic acid (6.5 mg, 0.03 mmol) in dry CH$_2$Cl$_2$ (3 mL) under argon atmosphere. The mixture was stirred for 1 hour at room temperature before PBD 27 (34 mg, crude) was added. Stirring was maintained until the reaction was complete (6 hours). The reaction was diluted with CH$_2$Cl$_2$ and the organic phase was washed with H$_2$O and brine before being dried over MgSO$_4$, filtered and excess solvent removed by rotary evaporation under reduced pressure by rotary evaporation under reduced pressure. The product was purified by careful silica gel chromatography (slow elution starting with 100% CHCl$_3$ up to 9:1 CHCl$_3$/MeOH) followed by reverse phase chromatography to remove unreacted maleimide-PEGs-acid. The product 28 was isolated in 41% over two steps (14.6 mg). LC/MS 2.40 min (ES+) m/z (relative intensity) 1157 ([M+H]$^+$., 5%)

E. Synthesis of Drug-Linker DL2 (Route 2)

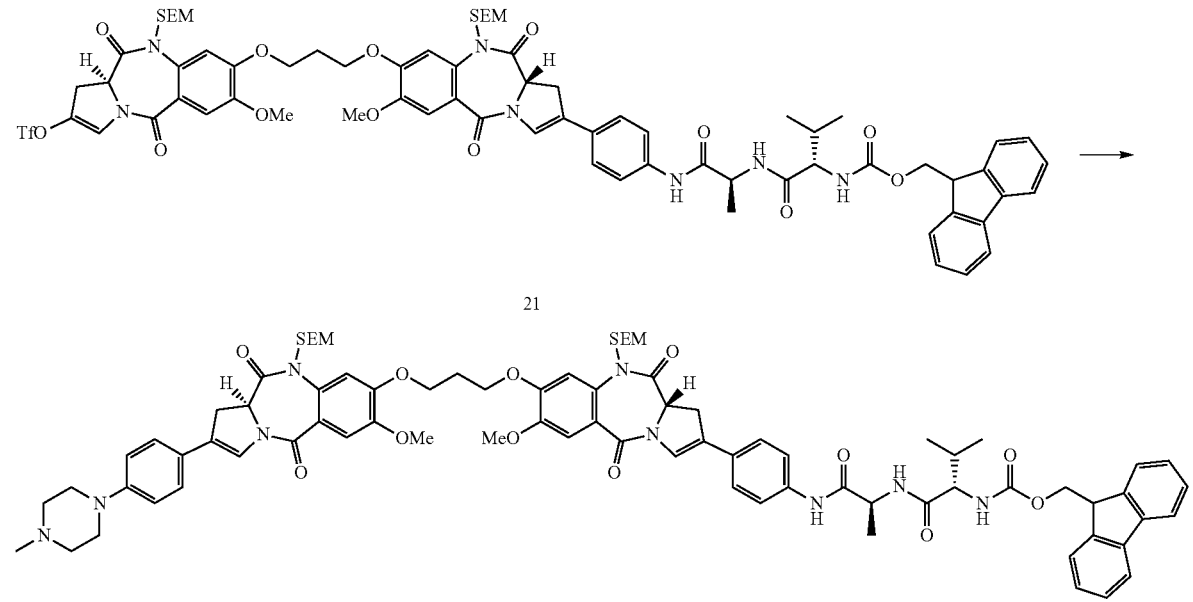

PBD-triflate 21 (469 mg, 0.323 mmol), boronic pinacol ester (146.5 mg, 0.484 mmol) and Na$_2$CO$_3$ (157 mg, 1.48 mmol) were dissolved in a mixture of toluene/MeOH/H$_2$O, 2:1:1 (10 mL). The reaction flask was purged with argon three times before tetrakis(triphenylphosphine)palladium(0) (7.41 mg, 0.0064 mmol) was added and the reaction mixture heated to 30° C. overnight. The solvents were removed under reduced pressure and the residue was taken up in H$_2$O (50 mL) and extracted with EtOAc (3×50 mL). The combined organics were washed with brine (100 mL), dried with MgSO$_4$, filtered and the volatiles removed by rotary evaporation under reduced pressure. The crude product was purified by silica gel column chromatography (CHCl$_3$ 100% to CHCl$_3$/MeOH 95%:5%) to afford pure 25 in 33% yield (885 mg). LC/MS 3.27 min (ES+) m/z (relative intensity) 1478 ([M+H]$^+$., 100%).

F. Synthesis of Drug-Linker DL3 (Route 1)

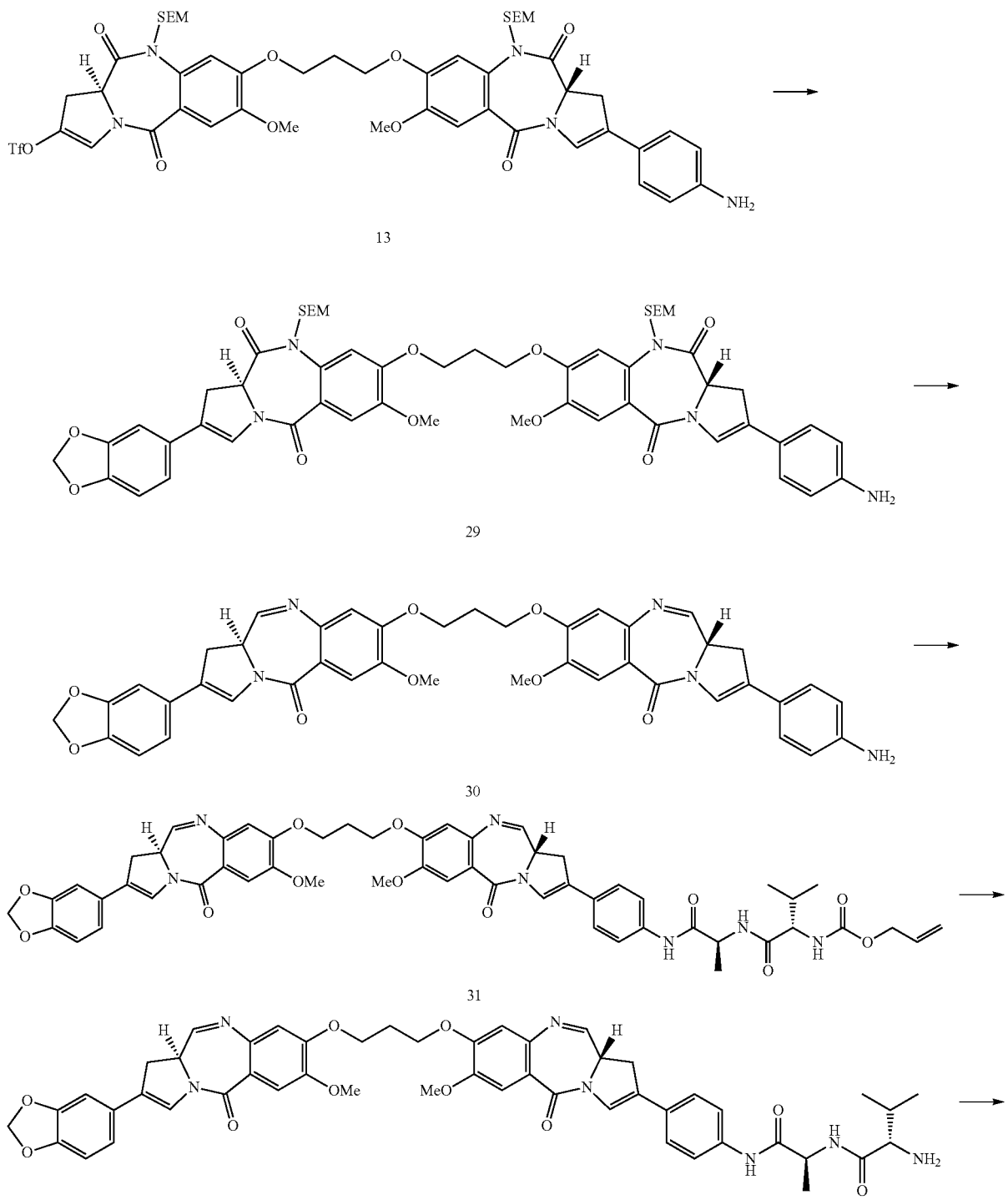

-continued

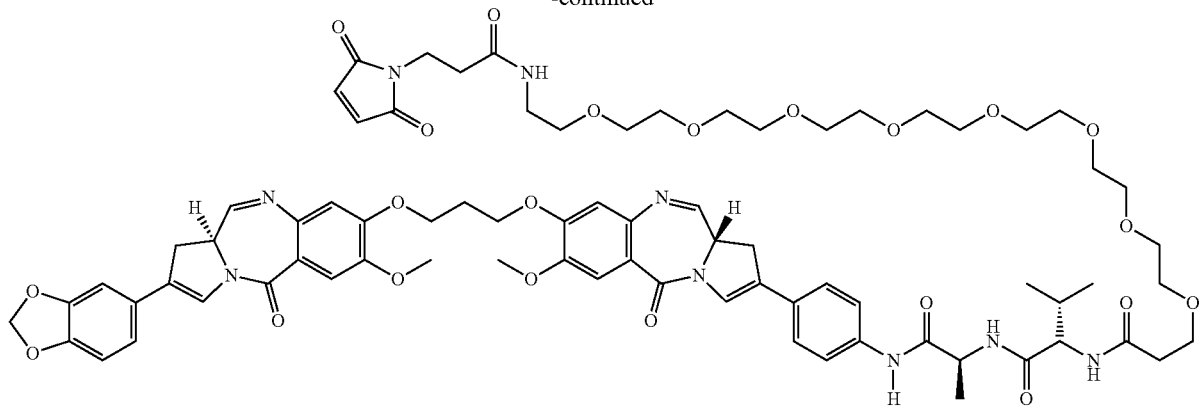

33

(a) (S)-2-(4-Aminophenyl)-8-(3-(((S)-2-(benzo[d][1,3]dioxol-5-yl)-7-methoxy-5,11-dioxo-10-((2-(trimethylsilyl)ethoxy)methyl)-5,10,11,11a-tetrahydro-1H-pyrrolo[2,1-c][1,4]benzodiazepin-8-yl)oxy)propoxy)-7-methoxy-10-((2-(trimethylsilyl)ethoxy)methyl)-1H-pyrrolo[2,1-c][1,4]benzodiazepine-5,11 (10H,11aH)-dione (29)

3,4-(Methylenedioxy)phenyl boronic acid (356 mg, 2.1 mmol, 1.3 equiv.), TEA (1.8 mL, 12.9 mmol, 8 equiv.) and triflate/aniline 13 (1.75 g, 1.7 mmol, 1 equiv.) were dissolved in a mixture of ethanol (7 mL), toluene (13 mL) and water (2 mL) under an Ar atmosphere. The reaction mixture was evacuated and flushed with Ar 3 times, before addition of tetrakis(triphenylphosphine)palladium(0) (114 mg, 0.1 mmol, 0.06 equiv.). The flask was again evacuated and flushed with Ar 3 times and heated in a microwave at 80° C. for 8 minutes with 30 seconds pre-stirring time. Analysis by TLC (80:20 v/v ethyl acetate/hexane) indicated complete consumption of starting material. The reaction mixture was diluted with dichloromethane (50 mL) and washed with water (50 mL). The organic layer was dried with $MgSO_4$, filtered and the solvent removed in vacuo. Purification by silica gel column chromatography (60:40 to 20:80 v/v hexane/ethyl acetate) afforded the product 29 as a yellow solid (1.21 g, 71%). LC/MS (3.92 min (ES$^+$) m/z (relative intensity) 1032.44 ([M+H]$^+$., 100).

(b) (S)-2-(4-Aminophenyl)-8-(3-(((S)-2-(benzo[d][1,3]dioxol-5-yl)-7-methoxy-5-oxo-5,11a-dihydro-1H-pyrrolo[2,1-c][1,4]benzodiazepin-8-yl)oxy)propoxy)-7-methoxy-1H-pyrrolo[2,1-c][1,4]benzodiazepin-5(11aH)-one (30)

SEM dilactam 29 (0.25 g, 0.24 mmol, 1 equiv.) was dissolved in THF (8 mL) and cooled to −78° C. under an Ar atmosphere. Super-Hydride® (0.6 mL, 1 M in THF, 2.5 equiv.) was added drop wise over 5 minutes while monitoring the temperature. After 20 minutes a small sample was taken and worked-up for LCMS analysis. Water (50 mL) was added, the cold bath was removed and the solution washed with ethyl acetate (50 mL). The organic layer was extracted and washed with brine (60 mL), dried with $MgSO_4$, filtered and the solvent removed in vacuo. The crude product was dissolved in EtOH (15 mL), $CH_2Cl_2$ (7.5 mL) and water (2.5 mL) and enough silica gel was added until it was a thick suspension. After 5 days stirring, it was filtered through a sintered funnel and washed with $CH_2Cl_2$/MeOH (9:1) (100 mL) until product ceased to be eluted. The organic layer was washed with brine (2×50 mL), dried with $MgSO_4$, filtered and the solvent removed in vacuo. Purification by silica gel column chromatography ($CHCl_3$ with 1% to 4% MeOH gradient) afforded the product 30 as a yellow solid (94 mg, 53%). LC/MS (2.53 min (ES$^+$) m/z (relative intensity) 739.64 ([M]', 70).

(c) Allyl ((S)-1-(((S)-1-((4-((S)-8-(3-(((S)-2-(benzo[d][1,3]dioxol-5-yl)-7-methoxy-5-oxo-5,11a-dihydro-1H-pyrrolo[2,1-c][1,4]benzodiazepin-8-yl)oxy)propoxy)-7-methoxy-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)carbamate (31)

Under an Ar atmosphere, Alanine-Valine-Alloc (180 mg, 0.66 mmol, 1.2 equiv.) was stirred with EEDQ (163 mg, 0.66 mmol, 1.2 equiv.) in anhydrous $CH_2Cl_2$ (21 mL) and methanol (1 mL) for 1 hour. The PBD 30 (407 mg, 0.55 mmol, 1 equiv.) was dissolved in anhydrous $CH_2Cl_2$ (21 mL) and methanol (1 mL) and added to the reaction. LC/MS after 5 days stirring at room temperature showed majority product formation. The solvent was removed in vacuo before purification by column chromatography ($CH_2Cl_2$ with 1% to 6% MeOH gradient) to yield the product 31 as a yellow solid (184 mg, 34%). LC/MS (2.95 min (ES$^+$) m/z (relative intensity) 994.95 ([M+H]$^+$., 60).

(d) (S)-2-Amino-N—((S)-1-((4-((S)-8-(3-(((S)-2-(benzo[d][1,3]dioxol-5-yl)-7-methoxy-5-oxo-5,11a-dihydro-1H-pyrrolo[2,1-c][1,4]benzodiazepin-8-yl)oxy)propoxy)-7-methoxy-5-oxo-5,11a-dihydro-1H-pyrrolo[2,1-c][1,4]benzodiazepin-2-yl)phenyl)amino)-1-oxopropan-2-yl)-3-methylbutanamide (32)

The imine 31 (100 mg, 0.1 mmol, 1 equiv.) was dissolved in anhydrous DCM (10 mL) (with the aid of one drop of methanol to aid dissolution) under an Ar atmosphere. Pyrrolidine (30 μL, 0.15 mmol, 1.5 equiv.) was added drop wise before the flask was evacuated and flushed with Ar three times. Pd(PPh$_3$)$_4$ (7 mg, 6 μmol, 0.06 equiv.) was added and the flask was evacuated and flushed with Ar three times. LC/MS analysis after 1 hour indicated product formation and complete loss of starting material. Et$_2$O (60 mL) was added to the reaction mixture and it was left to stir until all the product had crashed out of solution. The precipitate was filtered through a sintered funnel and washed twice with Et$_2$O (2×20 mL). The collection flask was replaced and the isolated solid was dissolved and washed through the sinter with CHCl$_3$ (100 mL). The solvent was removed in vacuo to afford the crude product 32 as a yellow solid which was used directly in the next step. LC/MS (1.14 min (ES$^+$) m/z (relative intensity) 910.40 ([M+H]$^+$., 67).

(e) N—((S)-1-(((S)-1-((4-((S)-8-(3-(((S)-2-(Benzo[d][1,3]dioxol-5-yl)-7-methoxy-5-oxo-5,11a-dihydro-1H-pyrrolo[2,1-c][1,4]benzodiazepin-8-yl)oxy)propoxy)-7-methoxy-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)-1-(3-(2,5-dioxo-2,5-dihydro-1H-pyrrol-1-yl)propanamido)-3,6,9,12,15,18,21,24-octaoxaheptacosan-27-amide (33 or DL 3)

The imine 32 (92 mg, 0.1 mmol, 1.1 equiv.) was dissolved in CHCl$_3$ (6 mL) with one drop of anhydrous MeOH to aid dissolution. Maleimide-PEGs-acid (53 mg, 0.09 mmol, 1 equiv.) was added followed by EEDQ (33 mg, 0.14 mmol, 1.5 equiv.). This was left to stir vigorously at room temperature under Ar for 4 days until LC/MS analysis showed majority product formation. The solvent was removed in vacuo and the crude product was partially purified by silica gel column chromatography (CHCl$_3$ with 1% to 10% MeOH gradient) yielding 33 (81 mg). The material was purified further by preparative HPLC to give 33 as a yellow solid (26.3 mg, 18%). Fast Formic run: LC/MS (1.39 min (ES+) m/z (relative intensity) 1485.00 ([M+H]+., 64).

G. Synthesis of Drug-Linker DL3 (Route 2)

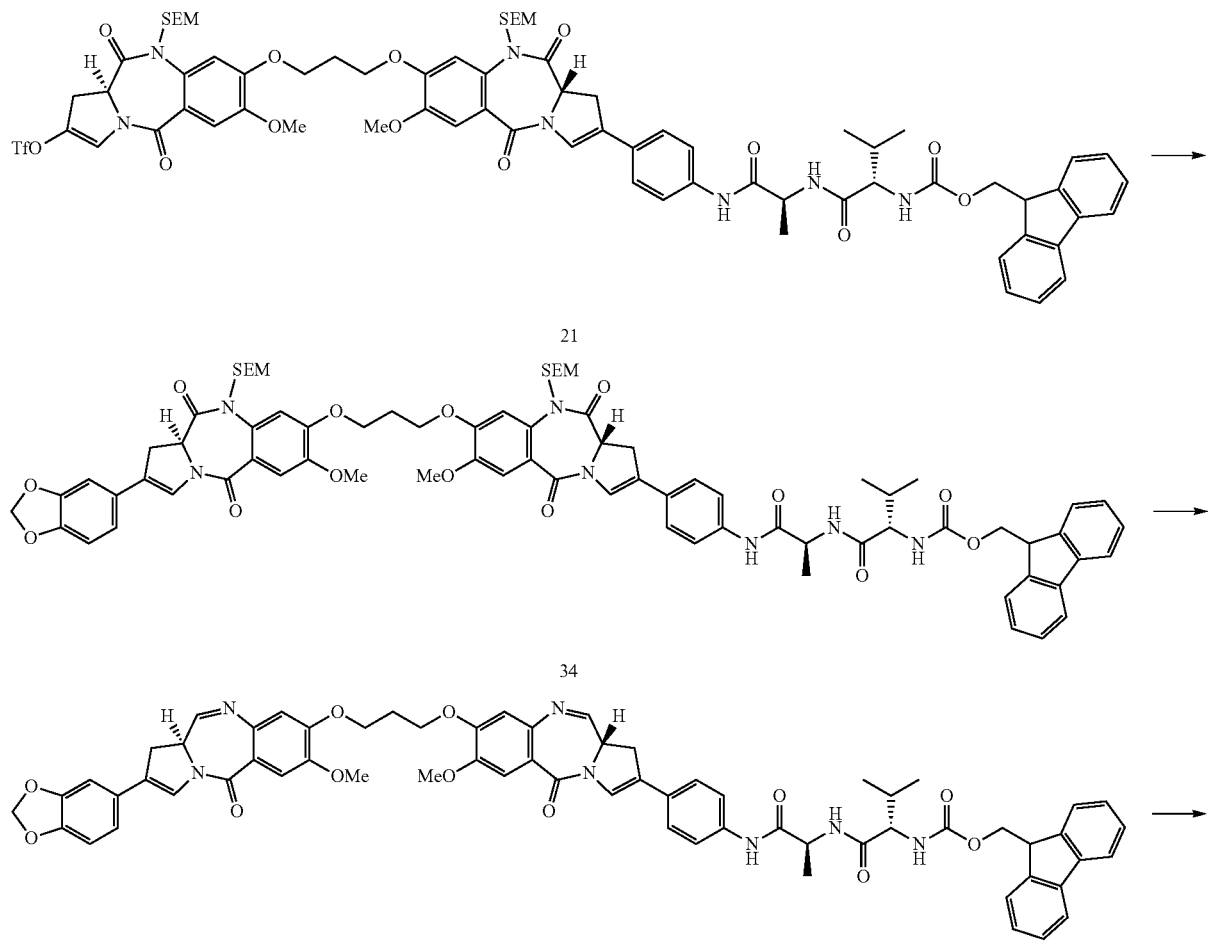

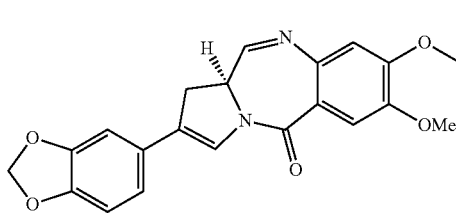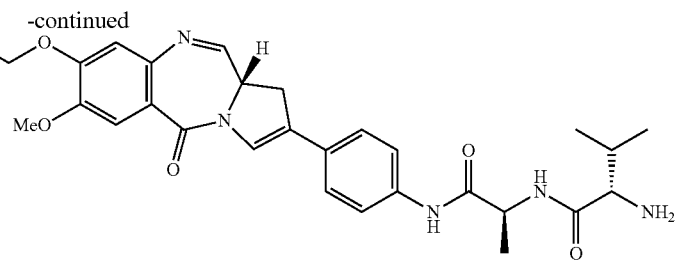

-continued (a) 9H-Fluoren-9-yl)methyl ((S)-1-(((S)-1-((4-((S)-8-(3-(((S)-2-(benzo[d][1,3]dioxol-5-yl)-7-methoxy-5,11-dioxo-10-((2-(trimethylsilyl) ethoxy)methyl)-5,10,11,11a-tetrahydro-1H-pyrrolo[2,1-c][1,4]benzodiazepin-8-yl)oxy)propoxy)-7-methoxy-5,11-dioxo-10-((2-(trimethylsilyl)ethoxy)methyl)-5,10,11,11a-tetrahydro-1H-pyrrolo[2,1-c][1,4]benzodiazepin-2-yl)phenyl)amino)-1-oxopropan-2-yl)amino)-3-methyl-1-oxobutan-2-yl)carbamate (34)

The triflate 21 (0.5 g, 0.35 mmol, 1 equiv.), 3,4-(methylenedioxy)phenyl boronic acid (75 mg, 0.45 mmol, 1.3 equiv.) and $Na_2CO_3$ (0.17 g, 1.6 mmol, 4.5 equiv.) were dissolved in toluene (11 mL), EtOH (5.5 mL) and water (5.5 mL) under an Ar atmosphere. The flask was evacuated and flushed with Ar three times. $Pd(PPh_3)_4$ (24 mg, 0.02 mmol, 0.06 equiv.) was added and again the flask was evacuated and flushed with Ar three times. This was heated to 30° C. and left stirring overnight. Analysis by LC/MS showed complete loss of starting material. The solvent was removed in vacuo and the residue dissolved in water (60 mL) before washing with ethyl acetate (60 mL×3). The combined organic layers were washed with brine (50 mL), dried with $MgSO_4$, filtered and the solvent removed in vacuo. Purification by column chromatography (50:50 to 25:75 v/v hexane/ethyl acetate) afforded the product 34 as a yellow solid (310 mg, 64%). LC/MS (1.44 min (ES⁻) m/z (relative intensity) 1423.35 ([M–H]⁺., 79).

(b) (9H-Fluoren-9-yl)methyl ((S)-1-(((S)-1-((4-((S)-8-(3-(((S)-2-(benzo[d][1,3]dioxol-5-yl)-7-methoxy-5-oxo-5,11a-dihydro-1H-pyrrolo[2,1-c][1,4]benzodiazepin-8-yl)oxy)propoxy)-7-methoxy-5-oxo-5,11a-dihydro-1H-pyrrolo[2,1-c][1,4]benzodiazepin-2-yl)phenyl)amino)-1-oxopropan-2-yl)amino)-3-methyl-1-oxobutan-2-yl)carbamate (35)

SEM dilactam 34 (0.31 g, 0.22 mmol, 1 equiv.) was dissolved in THF (10 mL) and cooled to −78° C. under an Ar atmosphere. Super-Hydride® (0.5 mL, 1 M in THF, 2.5 equiv.) was added drop wise over 5 minutes while monitoring the temperature. After 30 minutes a small sample was taken and worked-up for LC/MS analysis. Water (50 mL) was added, the cold bath was removed and the solution washed with ethyl acetate (50 mL). The organic layer was extracted and washed with brine (60 mL), dried with $MgSO_4$, filtered and the solvent removed in vacuo. The crude product was dissolved in EtOH (13.2 mL), $CH_2Cl_2$ (6.6 mL) and water (2.2 mL) and enough silica gel was added until it was a thick suspension. After 5 days stirring, it was filtered through a sintered funnel and washed with $CH_2Cl_2$/MeOH (9:1) (100 mL) until product ceased to be eluted. The organic layer was washed with brine (2×50 mL), dried with $MgSO_4$, filtered and the solvent removed in vacuo. Purification by silica gel column chromatography ($CHCl_3$ with 1% to 4% MeOH gradient) afforded the pure product 35 as a yellow solid (185 mg, 75%). LC/MS (1.70 min (ES⁺) m/z (relative intensity) 1132.85 ([M+H]⁺., 60).

(c) (S)-2-Amino-N—((S)-1-((4-((S)-8-(3-(((S)-2-(benzo[d][1,3]dioxol-5-yl)-7-methoxy-5-oxo-5,11a-dihydro-1H-pyrrolo[2,1-c][1,4]benzodiazepin-8-yl)oxy)propoxy)-7-methoxy-5-oxo-5,11a-dihydro-1H-pyrrolo[2,1-c][1,4]benzodiazepin-2-yl)phenyl)amino)-1-oxopropan-2-yl)-3-methylbutanamide (32)

The imine 35 (82 mg, 0.07 mmol, 1 equiv.) was dissolved in DMF (1 mL) before piperidine (0.2 mL, 2 mmol, excess) was added slowly. This solution was left to stir at room temperature for 20 minutes until LC/MS analysis showed complete consumption of starting material. The reaction mixture was diluted with $CH_2Cl_2$ (50 mL), washed with water (50 mL×4), dried with $MgSO_4$, filtered and the solvent removed in vacuo. The product 33 was used without further purification in the next step. LC/MS (1.15 min (ES⁺) m/z (relative intensity) 910.60 ([M+H], 58).

H. Synthesis of Drug-Linker DL5

(i) (S)-(2-amino-5-methoxy-4-((triisopropylsilyl)oxy)phenyl)(2-(((tert-butyldimethylsilyl)oxy)methyl)-4-methyl-2,3-dihydro-1H-pyrrol-1-yl)methanone (49)

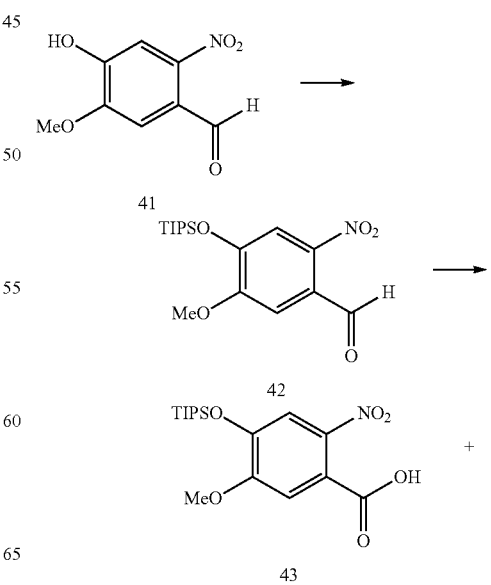

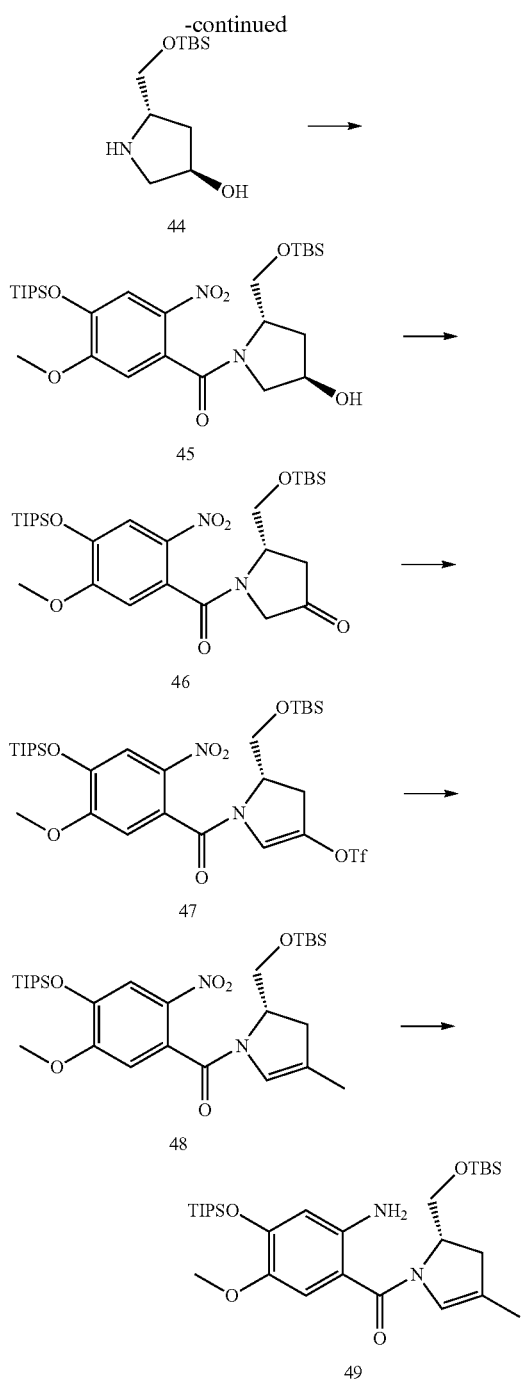

(a) 5-methoxy-2-nitro-4-((triisopropylsilyl)oxy)benzaldehyde (42)

Neat triisopropylsilylchloride (56.4 mL, 262 mmol) was added to a mixture of imidazole (48.7 g, 715.23 mmol) and 4-hydroxy-5-methoxy-2-nitrobenzaldehyde 41 (47 g, 238 mmol) (ground together). The mixture was heated until the phenol and imidazole melted and went into solution (100° C.). The reaction mixture was allowed to stir for 15 minutes and was then allowed to cool, whereupon a solid was observed to form at the bottom of the flask (imidazole chloride). The reaction mixture was diluted with 5% EtOAc/hexanes and loaded directly onto silica gel and the pad was eluted with 5% EtOAc/hexanes, followed by 10% EtOAc/hexanes (due to the low excess, very little unreacted TIPSCl was found in the product). The desired product was eluted with 5% ethyl acetate in hexane. Excess eluent was removed by rotary evaporation under reduced pressure, followed by drying under high vacuum to afford a crystalline light sensitive solid (74.4 g, 88%). Purity satisfactory by LC/MS (4.22 min (ES+) m/z (relative intensity) 353.88 ([M+H]+., 100)); $^1$H NMR (400 MHz, CDCl$_3$) δ 10.43 (s, 1H), 7.60 (s, 1H), 7.40 (s, 1H), 3.96 (s, 3H), 1.35-1.24 (m, 3H), 1.10 (m, 18H).

(b) 5-methoxy-2-nitro-4-((triisopropylsilyl)oxy)benzoic acid (43)

A solution of sodium chlorite (47.3 g, 523 mmol, 80% technical grade) and sodium dihydrogenphosphate monobasic (35.2 g, 293 mmol) (NaH$_2$PO$_4$) in water (800 mL) was added to a solution of compound 2 (74 g, 209 mmol) in tetrahydrofuran (500 mL) at room temperature. Hydrogen peroxide (60% w/w, 140 mL, 2.93 mol) was immediately added to the vigorously stirred biphasic mixture. The reaction mixture evolved gas (oxygen), the starting material dissolved and the temperature of the reaction mixture rose to 45° C. After 30 minutes LC/MS revealed that the reaction was complete. The reaction mixture was cooled in an ice bath and hydrochloric acid (1 M) was added to lower the pH to 3 (this step was found unnecessary in many instances, as the pH at the end of the reaction is already acidic; please check the pH before extraction). The reaction mixture was then extracted with ethyl acetate (1 L) and the organic phases washed with brine (2×100 mL) and dried over magnesium sulphate. The organic phase was filtered and excess solvent removed by rotary evaporation under reduced pressure to afford the product 43 in quantitative yield as a yellow solid. LC/MS (3.93 min (ES−) m/z (relative intensity) 367.74 ([M−H]−., 100)); $^1$H NMR (400 MHz, CDCl$_3$) δ 7.36 (s, 1H), 7.24 (s, 1H), 3.93 (s, 3H), 1.34-1.22 (m, 3H), 1.10 (m, 18H).

(c) ((2S,4R)-2-(((tert-butyldimethylsilyl)oxy)methyl)-4-hydroxypyrrolidin-1-yl) (5-methoxy-2-nitro-4-((triisopropylsilyl)oxy)phenyl)methanone (45)

DCC (29.2 g, 141 mmol, 1.2 eq) was added to a solution of acid 3 (43.5 g, 117.8 mmol, 1 eq), and hydroxybenzotriazole hydrate (19.8 g, 129.6 mmol, 1.1 eq) in dichloromethane (200 mL) at 0° C. The cold bath was removed and the reaction was allowed to proceed for 30 mins at room temperature, at which time a solution of (2S,4R)-2-t-butyldimethylsilyloxymethyl-4-hydroxypyrrolidine 44 (30 g, 129.6 mmol, 1.1 eq) and triethylamine (24.66 mL, 176 mmol, 1.5 eq) in dichloromethane (100 mL) was added rapidly at −10° C. under argon (on large scale, the addition time could be shortened by cooling the reaction mixture even further. The reaction mixture was allowed to stir at room temperature for 40 minutes to 1 hour and monitored by LC/MS and TLC (EtOAc). The solids were removed by filtration over celite and the organic phase was washed with cold aqueous 0.1 M HCl until the pH was measured at 4 or 5. The organic phase was then washed with water, followed by saturated aqueous sodium bicarbonate and brine. The organic layer was dried over magnesium sulphate, filtered and excess solvent removed by rotary evaporation under reduced pressure. The residue was subjected to column flash chromatography (silica gel; gradient 40/60 ethyl acetate/ hexane to 80/20 ethyl acetate/hexane). Excess solvent was removed by rotary evaporation under reduced pressure afforded the pure product 45, (45.5 g of pure product 66%, and 17 g of slightly impure product, 90% in total). LC/MS 4.43 min (ES+) m/z (relative intensity) 582.92 ([M+H]+., 100); $^1$H NMR (400 MHz, CDCl$_3$) δ 7.66 (s, 1H), 6.74 (s, 1H), 4.54 (s, 1H), 4.40 (s, 1H), 4.13 (s, 1H), 3.86 (s, 3H), 3.77 (d, J=9.2 Hz, 1H), 3.36 (dd, J=11.3, 4.5 Hz, 1H), 3.14-3.02 (m, 1H), 2.38-2.28 (m, 1H), 2.10 (ddd, J=13.3, 8.4, 2.2 Hz, 1H), 1.36-1.19 (m, 3H), 1.15-1.05 (m, 18H), 0.91 (s, 9H), 0.17-0.05 (m, 6H), (presence of rotamers).

(d) (S)-5-(((tert-butyldimethylsilyl)oxy)methyl)-1-(5-methoxy-2-nitro-4-((triisopropylsilyl)oxy)benzoyl)pyrrolidin-3-one (46)

TCCA (8.82 g, 40 mmol, 0.7 eq) was added to a stirred solution of 45 (31.7 g, 54 mmol, 1 eq) and TEMPO (0.85 g, 5.4 mmol, 0.1 eq) in dry dichloromethane (250 mL) at 0° C. The reaction mixture was vigorously stirred for 20 minutes, at which point TLC (50/50 ethyl acetate/hexane) revealed complete consumption of the starting material. The reaction mixture was filtered through celite and the filtrate washed with aqueous saturated sodium bicarbonate (100 mL), sodium thiosulphate (9 g in 300 mL), brine (100 mL) and dried over magnesium sulphate. Rotary evaporation under reduced pressure afforded product 46 in quantitative yield. LC/MS 4.52 min (ES+) m/z (relative intensity) 581.08 ([M+H]+., 100);
$^1$H NMR (400 MHz, CDCl$_3$) δ 7.78-7.60 (m, 1H), 6.85-6.62 (m, 1H), 4.94 (dd, J=30.8, 7.8 Hz, 1H), 4.50-4.16 (m, 1H), 3.99-3.82 (m, 3H), 3.80-3.34 (m, 3H), 2.92-2.17 (m, 2H), 1.40-1.18 (m, 3H), 1.11 (t, J=6.2 Hz, 18H), 0.97-0.75 (m, 9H), 0.15--0.06 (m, 6H), (presence of rotamers).

(e) (S)-5-(((tert-butyldimethylsilyl)oxy)methyl)-1-(5-methoxy-2-nitro-4-((triisopropylsilyl)oxy)benzoyl)-4,5-dihydro-1H-pyrrol-3-yl trifluoromethanesulfonate (47)

Triflic anhydride (27.7 mL, 46.4 g, 165 mmol, 3 eq) was injected (temperature controlled) to a vigorously stirred suspension of ketone 46 (31.9 g, 55 mmol, 1 eq) in dry dichloromethane (900 mL) in the presence of 2,6-lutidine (25.6 mL, 23.5 g, 220 mmol, 4 eq, dried over sieves) at −50° C. (acetone/dry ice bath). The reaction mixture was allowed to stir for 1.5 hours when LC/MS, following a mini work-up (water/dichloromethane), revealed the reaction to be complete. Water was added to the still cold reaction mixture and the organic layer was separated and washed with saturated sodium bicarbonate, brine and magnesium sulphate. The organic phase was filtered and excess solvent was removed by rotary evaporation under reduced pressure. The residue was subjected to column flash chromatography (silica gel; 10/90 v/v ethyl acetate/hexane), removal of excess eluent afforded the product 47 (37.6 g, 96%) LC/MS, method 2, 4.32 min (ES+) m/z (relative intensity) 712.89 ([M+H]+., 100); $^1$H NMR (400 MHz, CDCl$_3$) δ 7.71 (s, 1H), 6.75 (s, 1H), 6.05 (d, J=1.8 Hz, 1H), 4.78 (dd, J=9.8, 5.5 Hz, 1H), 4.15-3.75 (m, 5H), 3.17 (ddd, J=16.2, 10.4, 2.3 Hz, 1H), 2.99 (ddd, J=16.3, 4.0, 1.6 Hz, 1H), 1.45-1.19 (m, 3H), 1.15-1.08 (m, 18H), 1.05 (s, 6H), 0.95-0.87 (m, 9H), 0.15-0.08 (m, 6H).

(f) (S)-2-(((tert-butyldimethylsilyl)oxy)methyl)-4-methyl-2,3-dihydro-1H-pyrrol-1-yl) (5-methoxy-2-nitro-4-((triisopropylsilyl)oxy)phenyl)methanone (48)

Triphenylarsine (1.71 g, 5.60 mmol, 0.4 eq) was added to a mixture of triflate 47 (10.00 g, 14 mmol, 1 eq), methylboronic acid (2.94 g, 49.1 mmol, 3.5 eq), silver oxide (13 g, 56 mmol, 4 eq) and potassium phosphate tribasic (17.8 g, 84 mmol, 6 eq) in dry dioxane (80 mL) under an argon atmosphere. The reaction was flushed with argon 3 times and bis(benzonitrile)palladium(II) chloride (540 mg, 1.40 mmol, 0.1 eq) was added. The reaction was flushed with argon 3 more times before being warmed instantaneously to 110° C. (the drysyn heating block was previously warmed to 110° C. prior addition of the flask). After 10 mins the reaction was cooled to room temperature and filtered through a pad celite. The solvent was removed by rotary evaporation under reduced pressure. The resulting residue was subjected to column flash chromatography (silica gel; 10% ethyl acetate/hexane). Pure fractions were collected and combined, and excess eluent was removed by rotary evaporation under reduced pressure afforded the product 48 (4.5 g, 55%). LC/MS, 4.27 min (ES+) m/z (relative intensity) 579.18 ([M+H]+., 100); $^1$H NMR (400 MHz, CDCl$_3$) δ 7.70 (s, 1H), 6.77 (s, 1H), 5.51 (d, J=1.7 Hz, 1H), 4.77-4.59 (m, 1H), 3.89 (s, 3H), 2.92-2.65 (m, 1H), 2.55 (d, J=14.8 Hz, 1H), 1.62 (d, J=1.1 Hz, 3H), 1.40-1.18 (m, 3H), 1.11 (s, 9H), 1.10 (s, 9H), 0.90 (s, 9H), 0.11 (d, J=2.3 Hz, 6H).

(g) (S)-(2-amino-5-methoxy-4-((triisopropylsilyl)oxy)phenyl) (2-(((tert-butyldimethylsilyl)oxy)methyl)-4-methyl-2,3-dihydro-1H-pyrrol-1-yl) methanone (49)

Zinc powder (28 g, 430 mmol, 37 eq) was added to a solution of compound 48 (6.7 g, 11.58 mmol) in 5% formic acid in ethanol v/v (70 mL) at around 15° C. The resulting exotherm was controlled using an ice bath to maintain the temperature of the reaction mixture below 30° C. After 30 minutes the reaction mixture was filtered through a pad of celite. The filtrate was diluted with ethyl acetate and the organic phase was washed with water, saturated aqueous sodium bicarbonate and brine. The organic phase was dried over magnesium sulphate, filtered and excess solvent removed by rotary evaporation under reduced pressure. The resulting residue was subjected to flash column chromatography (silica gel; 10% ethyl acetate in hexane). The pure fractions were collected and combined and excess solvent was removed by rotary evaporation under reduced pressure to afford the product 49 (5.1 g, 80%). LC/MS, 4.23 min (ES+) m/z (relative intensity) 550.21 ([M+H]+., 100); $^1$H NMR (400 MHz, CDCl$_3$) δ 7.28 (s, 1H), 6.67 (s, 1H), 6.19 (s, 1H), 4.64-4.53 (m, J=4.1 Hz, 1H), 4.17 (s, 1H), 3.87 (s, 1H), 3.77-3.69 (m, 1H), 3.66 (s, 3H), 2.71-2.60 (m, 1H), 2.53-2.43 (m, 1H), 2.04-1.97 (m, J=11.9 Hz, 1H), 1.62 (s, 3H), 1.26-1.13 (m, 3H), 1.08-0.99 (m, 18H), 0.82 (s, 9H), 0.03--0.03 (m, J=6.2 Hz, 6H).

(ii) (11 S,11aS)-allyl 11-((tert-butyldimethylsilyl)oxy)-8-((5-iodopentyl)oxy)-7-methoxy-2-methyl-5-oxo-11,11a-dihydro-1H-benzo[e]pyrrolo[1,2-a][1,4]diazepine-10(5H)-carboxylate

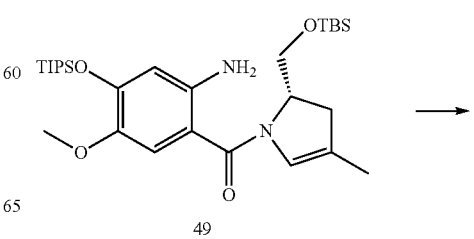

49

-continued

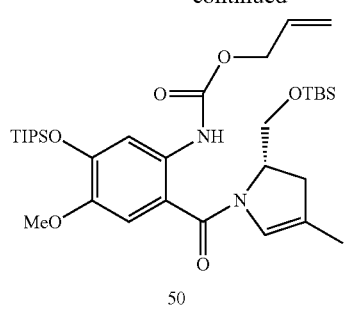

50

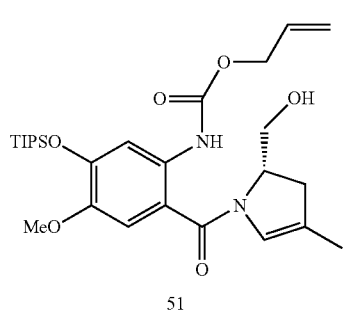

51

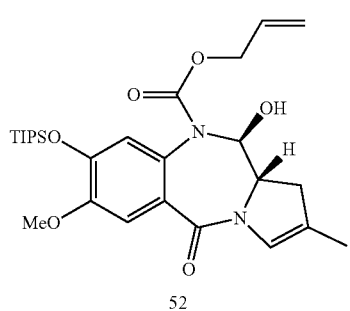

52

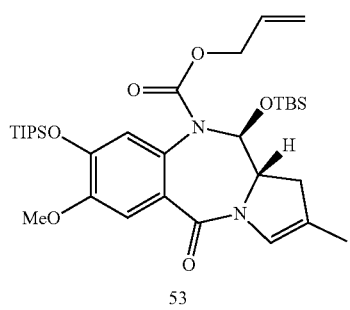

53

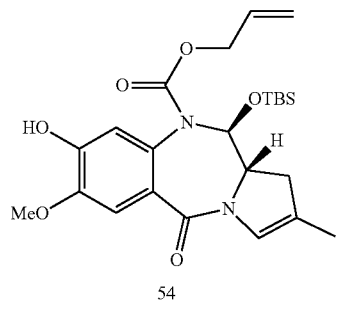

54

-continued

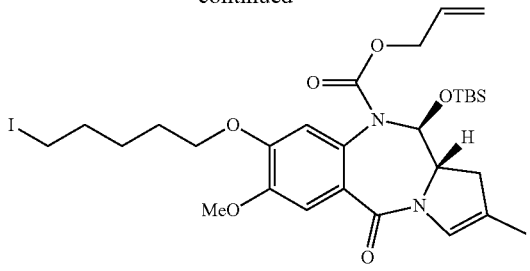

55

(a) (S)-allyl (2-(2-(((tert-butyldimethylsilyl)oxy)methyl)-4-methyl-2,3-dihydro-1H-pyrrole-1-carbonyl)-4-methoxy-5-((triisopropylsilyl)oxy)phenyl)carbamate (50)

Allyl chloroformate (0.30 mL, 3.00 mmol, 1.1 eq) was added to a solution of amine 49 (1.5 g, 2.73 mmol) in the presence of dry pyridine (0.48 mL, 6.00 mmol, 2.2 eq) in dry dichloromethane (20 mL) at −78° C. (acetone/dry ice bath). After 30 minutes, the bath was removed and the reaction mixture was allowed to warm to room temperature. The reaction mixture was diluted with dichloromethane and saturated aqueous copper sulphate was added. The organic layer was then washed sequentially with saturated aqueous sodium bicarbonate and brine. The organic phase was dried over magnesium sulphate, filtered and excess solvent removed by rotary evaporation under reduced pressure to afford the product 50 which was used directly in the next reaction. LC/MS, 4.45 min (ES+) m/z (relative intensity) 632.91 ([M+H]$^+$., 100)

(b) (S)-allyl (2-(2-(hydroxymethyl)-4-methyl-2,3-dihydro-1H-pyrrole-1-carbonyl)-4-methoxy-5-((triisopropylsilyl)oxy)phenyl)carbamate (51)

The crude 50 was dissolved in a 7:1:1:2 mixture of acetic acid/methanol/tetrahydrofuran/water (28:4:4:8 mL) and allowed to stir at room temperature. After 3 hours, complete disappearance of starting material was observed by LC/MS. The reaction mixture was diluted with ethyl acetate and washed sequentially with water (2×500 mL), saturated aqueous sodium bicarbonate (200 mL) and brine. The organic phase was dried over magnesium sulphate filtered and excess ethyl acetate removed by rotary evaporation under reduced pressure. The resulting residue was subjected to flash column chromatography (silica gel, 25% ethyl acetate in hexane). Pure fractions were collected and combined and excess eluent was removed by rotary evaporation under reduced pressure to afford the desired product 51 (1 g, 71%). LC/MS, 3.70 min (ES+) m/z (relative intensity) 519.13 ([M+H]$^+$., 95); $^1$H NMR (400 MHz, CDCl$_3$) δ 8.34 (s, 1H), 7.69 (s, 1H), 6.78 (s, 1H), 6.15 (s, 1H), 5.95 (ddt, J=17.2, 10.5, 5.7 Hz, 1H), 5.33 (dq, J=17.2, 1.5 Hz, 1H), 5.23 (ddd, J=10.4, 2.6, 1.3 Hz, 1H), 4.73 (tt, J=7.8, 4.8 Hz, 1H), 4.63 (dt, J=5.7, 1.4 Hz, 2H), 4.54 (s, 1H), 3.89-3.70 (m, 5H), 2.87 (dd, J=16.5, 10.5 Hz, 1H), 2.19 (dd, J=16.8, 4.6 Hz, 1H), 1.70 (d, J=1.3 Hz, 3H), 1.38-1.23 (m, 3H), 1.12 (s, 10H), 1.10 (s, 8H).

(c) (11S,11aS)-allyl 11-hydroxy-7-methoxy-2-methyl-5-oxo-8-((triisopropylsilyl)oxy)-11,11a-dihydro-1H-benzo[e]pyrrolo[1,2-a][1,4]diazepine-10(5H)-carboxylate (52)

Dimethyl sulphoxide (0.35 mL, 4.83 mmol, 2.5 eq) was added dropwise to a solution of oxalyl chloride (0.2 mL, 2.32 mmol, 1.2 eq) in dry dichloromethane (10 mL) at −78° C. (dry ice/acetone bath) under an atmosphere of argon. After 10 minutes a solution of 51 (1 g, 1.93 mmol) in dry dichloromethane (8 mL) was added slowly with the temperature still at −78° C. After 15 min triethylamine (1.35 mL, dried over 4 Å molecular sieves, 9.65 mmol, 5 eq) was added dropwise and the dry ice/acetone bath was removed. The reaction mixture was allowed to reach room temperature and was extracted with cold hydrochloric acid (0.1 M), saturated aqueous sodium bicarbonate and brine. The organic phase was dried over magnesium sulphate, filtered and excess dichloromethane was removed by rotary evaporation under reduced pressure to afford product 52 (658 mg, 66%). LC/MS, 3.52 min (ES+) m/z (relative intensity) 517.14 ([M+H]$^+$., 100); $^1$H NMR (400 MHz, CDCl$_3$) δ 7.20 (s, 1H), 6.75-6.63 (m, J=8.8, 4.0 Hz, 2H), 5.89-5.64 (m, J=9.6, 4.1 Hz, 2H), 5.23-5.03 (m, 2H), 4.68-4.38 (m, 2H), 3.84 (s, 3H), 3.83-3.77 (m, 1H), 3.40 (s, 1H), 3.05-2.83 (m, 1H), 2.59 (d, J=17.1 Hz, 1H), 1.78 (d, J=1.3 Hz, 3H), 1.33-1.16 (m, 3H), 1.09 (d, J=2.2 Hz, 9H), 1.07 (d, J=2.1 Hz, 9H).

(d) (11S,11aS)-allyl 11-((tert-butyldimethylsilyl)oxy)-7-methoxy-2-methyl-5-oxo-8-((triisopropylsilyl)oxy)-11,11a-dihydro-1H-benzo[e]pyrrolo[1,2-a][1,4]diazepine-10(5H)-carboxylate (53)

Tert-butyldimethylsilyltriflate (0.70 mL, 3.00 mmol, 3 eq) was added to a solution of compound 52 (520 mg, 1.00 mmol) and 2,6-lutidine (0.46 mL, 4.00 mmol, 4 eq) in dry dichloromethane (40 mL) at 0° C. under argon. After 10 min, the cold bath was removed and the reaction mixture was stirred at room temperature for 1 hour. The reaction mixture was extracted with water, saturated aqueous sodium bicarbonate and brine. The organic phase was dried over magnesium sulphate, filtered and excess was removed by rotary evaporation under reduced pressure. The resulting residue was subjected to flash column chromatography (silica gel; gradient, 10% ethyl acetate in hexane to 20% ethyl acetate in hexane). Pure fractions were collected and excess eluent was removed by rotary evaporation under reduced pressure to give the product 53 (540 mg, 85%). LC/MS, 4.42 min (ES+) m/z (relative intensity) 653.14 ([M+Na]$^+$., 100); $^1$H NMR (400 MHz, CDCl$_3$) δ 7.20 (s, 1H), 6.71-6.64 (m, J=5.5 Hz, 2H), 5.83 (d, J=9.0 Hz, 1H), 5.80-5.68 (m, J=5.9 Hz, 1H), 5.14-5.06 (m, 2H), 4.58 (dd, J=13.2, 5.2 Hz, 1H), 4.36 (dd, J=13.3, 5.5 Hz, 1H), 3.84 (s, 3H), 3.71 (td, J=10.1, 3.8 Hz, 1H), 2.91 (dd, J=16.9, 10.3 Hz, 1H), 2.36 (d, J=16.8 Hz, 1H), 1.75 (s, 3H), 1.31-1.16 (m, 3H), 1.12-1.01 (m, J=7.4, 2.1 Hz, 18H), 0.89-0.81 (m, 9H), 0.25 (s, 3H), 0.19 (s, 3H).

(e) (11S,11aS)-allyl 11-((tert-butyldimethylsilyl)oxy)-8-hydroxy-7-methoxy-2-methyl-5-oxo-11,11a-dihydro-1H-benzo[e]pyrrolo[1,2-a][1,4]diazepine-10(5H)-carboxylate (54)

Lithium acetate (87 mg, 0.85 mmol) was added to a solution of compound 53 (540 mg, 0.85 mmol) in wet dimethylformamide (6 mL, 50:1 DMF/water). After 4 hours, the reaction was complete and the reaction mixture was diluted with ethyl acetate (25 mL) and washed with aqueous citric acid solution (pH~3), water and brine. The organic layer was dried over magnesium sulphate filtered and excess ethyl acetate was removed by rotary evaporation under reduced pressure. The resulting residue was subjected to flash column chromatography (silica gel; gradient, 25% to 75% ethyl acetate in hexane). Pure fractions were collected and combined and excess eluent was removed by rotary evaporation under reduced pressure to give the product 54 (400 mg, quantitative). LC/MS, (3.33 min (ES+) m/z (relative intensity) 475.26 ([M+H]$^+$, 100).

(f) (11 S,11aS)-allyl 11-((tert-butyldimethylsilyl)oxy)-8-((5-iodopentyl)oxy)-7-methoxy-2-methyl-5-oxo-11,11a-dihydro-1H-benzo[e]pyrrolo[1,2-a][1,4]diazepine-10(5H)-carboxylate (55)

Diiodopentane (0.63 mL, 4.21 mmol, 5 eq) and potassium carbonate (116 mg, 0.84 mmol, 1 eq) were added to a solution of phenol 54 (400 mg, 0.84 mmol) in acetone (4 mL, dried over molecular sieves). The reaction mixture was then warmed to 60° C. and stirred for 6 hours. Acetone was removed by rotary evaporation under reduced pressure. The resulting residue was subjected to flash column chromatography (silica gel; 50/50, v/v, hexane/ethyl acetate). Pure fractions were collected and combined and excess eluent was removed to provide 55 in 90% yield. LC/MS, 3.90 min (ES+) m/z (relative intensity) 670.91 ([M]$^+$., 100). $^1$H NMR (400 MHz, CDCl$_3$) δ 7.23 (s, 1H), 6.69 (s, 1H), 6.60 (s, 1H), 5.87 (d, J=8.8 Hz, 1H), 5.83-5.68 (m, J=5.6 Hz, 1H), 5.15-5.01 (m, 2H), 4.67-4.58 (m, 1H), 4.45-4.35 (m, 1H), 4.04-3.93 (m, 2H), 3.91 (s, 3H), 3.73 (td, J=10.0, 3.8 Hz, 1H), 3.25-3.14 (m, J=8.5, 7.0 Hz, 2H), 2.92 (dd, J=16.8, 10.3 Hz, 1H), 2.38 (d, J=16.8 Hz, 1H), 1.95-1.81 (m, 4H), 1.77 (s, 3H), 1.64-1.49 (m, 2H), 0.88 (s, 9H), 0.25 (s, 3H), 0.23 (s, 3H).

(iii) (11S,11aS)-4-(2-(1-((1-(allyloxy)-4-methyl-1,2-dioxopentan-3-yl)amino)-1-oxopropan-2-yl)hydrazinyl)benzyl 11-((tert-butyldimethylsilyl)oxy)-8-hydroxy-7-methoxy-2-methyl-5-oxo-11,11a-dihydro-1H-benzo[e]pyrrolo[1,2-a][1,4]diazepine-10(5H)-carboxylate (70)

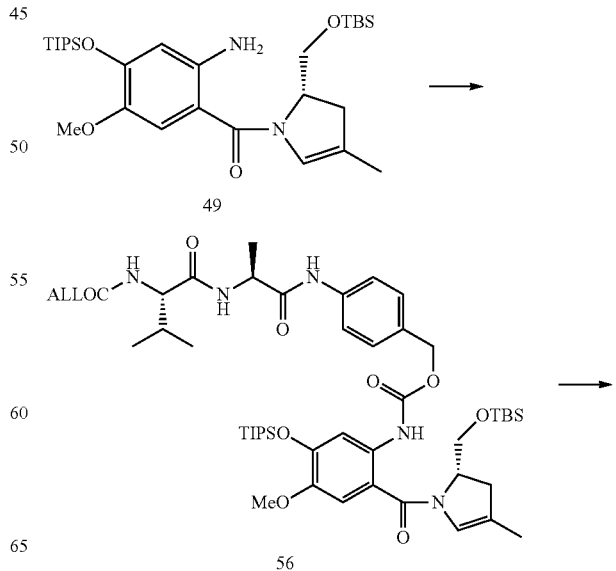

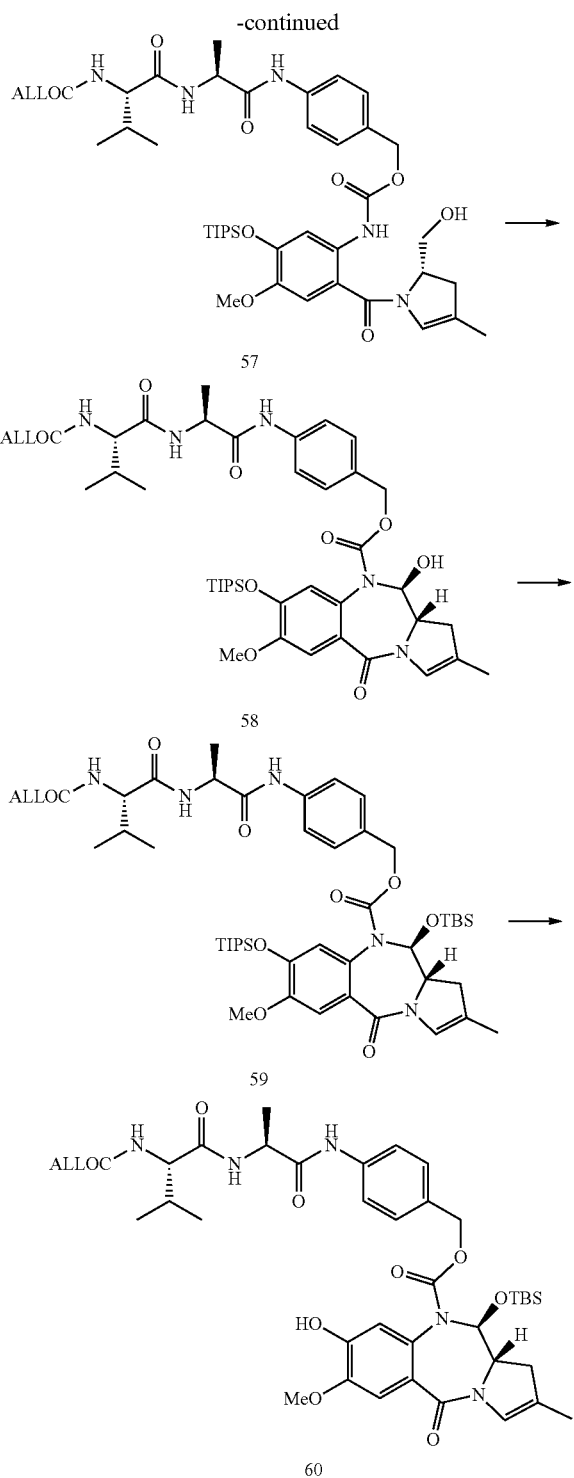

57

58

59

60

(a) Allyl 3-(2-(2-(4-((((2-((S)-2-(((tert-butyldimethylsilyl)oxy)methyl)-4-methyl-2,3-dihydro-1H-pyrrole-1-carbonyl)-4-methoxy-5-((triisopropylsilyl)oxy)phenyl)carbamoyl)oxy)methyl)phenyl) hydrazinyl)propanamido)-4-methyl-2-oxopentanoate (56)

Triethylamine (2.23 mL, 18.04 mmol, 2.2 eq) was added to a stirred solution of the amine 49 (4 g, 8.20 mmol) and triphosgene (778 mg, 2.95 mmol, 0.36 eq) in dry tetrahydrofuran (40 mL) at 5° C. (ice bath). The progress of the isocyanate reaction was monitored by periodically removing aliquots from the reaction mixture and quenching with methanol and performing LC/MS analysis. Once the isocyanate formation was complete a solution of the alloc-Val-Ala-PABOH (4.12 g, 12.30 mmol, 1.5 eq) and triethylamine (1.52 mL, 12.30 mmol, 1.5 eq) in dry tetrahydrofuran (40 mL) was rapidly added by injection to the freshly prepared isocyanate. The reaction mixture was allowed to stir at 40° C. for 4 hours. Excess solvent was removed by rotary evaporation under reduced pressure. The resulting residue was subjected to flash column chromatography (silica gel; gradient, 1% methanol to 5% methanol in dichloromethane). (Alternative chromatography conditions using EtOAc and Hexane have also been successful). Pure fractions were collected and combined and excess eluent was removed by rotary evaporation under reduced pressure to give the product 56 (3.9 g, 50%). LC/MS, 4.23 min (ES+) m/z (relative intensity) 952.36 ([M+H]$^+$., 100); $^1$H NMR (400 MHz, CDCl$_3$) δ 8.62 (br s, 1H), 8.46 (s, 1H), 7.77 (br s, 1H), 7.53 (d, J=8.4 Hz, 2H), 7.32 (d, J=8.5 Hz, 2H), 6.76 (s, 1H), 6.57 (d, J=7.6 Hz, 1H), 6.17 (s, 1H), 6.03-5.83 (m, 1H), 5.26 (dd, J=33.8, 13.5 Hz, 3H), 5.10 (s, 2H), 4.70-4.60 (m, 2H), 4.58 (dd, J=5.7, 1.3 Hz, 2H), 4.06-3.99 (m, 1H), 3.92 (s, 1H), 3.82-3.71 (m, 1H), 3.75 (s, 3H), 2.79-2.64 (m, 1H), 2.54 (d, J=12.9 Hz, 1H), 2.16 (dq, J=13.5, 6.7 Hz, 1H), 1.67 (s, 3H), 1.46 (d, J=7.0 Hz, 3H), 1.35-1.24 (m, 3H), 1.12 (s, 9H), 1.10 (s, 9H), 0.97 (d, J=6.8 Hz, 3H), 0.94 (d, J=6.8 Hz, 3H), 0.87 (s, 9H), 0.07--0.02 (m, 6H).

(b) Allyl 3-(2-(2-(4-((((2-((S)-2-(hydroxymethyl)-4-methyl-2,3-dihydro-1H-pyrrole-1-carbonyl)-4-methoxy-5-((triisopropylsilyl)oxy)phenyl)carbamoyl)oxy)methyl)phenyl) hydrazinyl)propanamido)-4-methyl-2-oxopentanoate (57)

The TBS ether 56 (1.32 g, 1.38 mmol) was dissolved in a 7:1:1:2 mixture of acetic acid/methanol/tetrahydrofuran/water (14:2:2:4 mL) and allowed to stir at room temperature. After 3 hours no more starting material was observed by LC/MS. The reaction mixture was diluted with ethyl acetate (25 mL) and washed sequentially with water, saturated aqueous sodium bicarbonate and brine. The organic phase was dried over magnesium sulphate filtered and excess ethyl acetate removed by rotary evaporation under reduced pressure. The resulting residue was subjected to flash column chromatography (silica gel, 2% methanol in dichloromethane). Pure fractions were collected and combined and excess eluent was removed by rotary evaporation under reduced pressure to afford the desired product 57 (920 mg, 80%). LC/MS, 3.60 min (ES+) m/z (relative intensity) 838.18 ([M+H]$^+$., 100). $^1$H NMR (400 MHz, CDCl$_3$) δ 8.55 (s, 1H), 8.35 (s, 1H), 7.68 (s, 1H), 7.52 (d, J=8.1 Hz, 2H), 7.31 (d, J=8.4 Hz, 2H), 6.77 (s, 1H), 6.71 (d, J=7.5 Hz, 1H), 6.13 (s, 1H), 5.97-5.82 (m, J=5.7 Hz, 1H), 5.41-5.15 (m, 3H), 5.10 (d, J=3.5 Hz, 2H), 4.76-4.42 (m, 5H), 4.03 (t, J=6.6 Hz, 1H), 3.77 (s, 5H), 2.84 (dd, J=16.7, 10.4 Hz, 1H), 2.26-2.08 (m, 2H), 1.68 (s, 3H), 1.44 (d, J=7.0 Hz, 3H), 1.30 (dt, J=14.7, 7.4 Hz, 3H), 1.12 (s, 9H), 1.10 (s, 9H), 0.96 (d, J=6.8 Hz, 3H), 0.93 (d, J=6.8 Hz, 3H).

(c) (11S,11aS)-4-(2-(1-((1-(allyloxy)-4-methyl-1,2-dioxopentan-3-yl)amino)-1-oxopropan-2-yl)hydrazinyl)benzyl 11-hydroxy-7-methoxy-2-methyl-5-oxo-8-((triisopropylsilyl)oxy)-11,11a-dihydro-1H-benzo[e]pyrrolo[1,2-a][1,4]diazepine-10(5H)-carboxylate (58)

Dimethyl sulphoxide (0.2 mL, 2.75 mmol, 2.5 eq) was added dropwise to a solution of oxalyl chloride (0.11 mL, 1.32 mmol, 1.2 eq) in dry dichloromethane (7 mL) at −78° C. (dry ice/acetone bath) under an atmosphere of argon. After 10 minutes a solution of 57 (920 mg, 1.10 mmol) in dry dichloromethane (5 mL) was added slowly with the temperature still at −78° C. After 15 min triethylamine (0.77 mL, dried over 4 Å molecular sieves, 5.50 mmol, 5 eq) was added dropwise and the dry ice/acetone bath was removed. The reaction mixture was allowed to reach room temperature and was extracted with cold hydrochloric acid (0.1 M), saturated aqueous sodium bicarbonate and brine. The organic phase was dried over magnesium sulphate, filtered and excess dichloromethane was removed by rotary evaporation under reduced pressure. The resulting residue was subjected to column flash chromatography (silica gel; gradient 2% methanol to 5% methanol in dichloromethane). Pure fractions were collected and combined and removal of excess eluent by rotary evaporation under reduced pressure afforded the product 58 (550 mg, 60%). LC/MS, 3.43 min (ES+) m/z (relative intensity) 836.01 ([M]+., 100). $^1$H NMR (400 MHz, CDCl$_3$) δ 8.39 (s, 1H), 7.52-7.40 (m, 2H), 7.21-7.08 (m, J=11.5 Hz, 2H), 6.67 (s, 1H), 6.60-6.47 (m, J=7.4 Hz, 1H), 5.97-5.83 (m, 1H), 5.79-5.66 (m, 1H), 5.38-4.90 (m, 6H), 4.68-4.52 (m, J=18.4, 5.5 Hz, 4H), 4.04-3.94 (m, J=6.5 Hz, 1H), 3.87-3.76 (m, 5H), 3.00-2.88 (m, 1H), 2.66-2.49 (m, 2H), 2.21-2.08 (m, 2H), 1.76 (s, 3H), 1.45 (d, J=7.0 Hz, 3H), 1.09-0.98 (m, J=8.9 Hz, 18H), 0.96 (d, J=6.7 Hz, 3H), 0.93 (d, J=6.9 Hz, 3H).

(d) (11S,11aS)-4-(2-(1-((1-(Allyloxy)-4-methyl-, 2-dioxopentan-3-yl)amino)-1-oxopropan-2-yl)hydrazinyl)benzyl 11-((tert-butyldimethylsilyl)oxy)-7-methoxy-2-methyl-5-oxo-8-((triisopropylsilyl)oxy)-11,11a-dihydro-1H-benzo[e]pyrrolo[1,2-a][1,4]diazepine-10(5H)-carboxylate (59)

Tert-butyldimethylsilyltriflate (0.38 mL, 1.62 mmol, 3 eq) was added to a solution of compound 58 (450 mg, 0.54 mmol) and 2,6-lutidine (0.25 mL, 2.16 mmol, 4 eq) in dry dichloromethane (5 mL) at 0° C. under argon. After 10 min, the cold bath was removed and the reaction mixture was stirred at room temperature for 1 hour. The reaction mixture was extracted with water, saturated aqueous sodium bicarbonate and brine. The organic phase was dried over magnesium sulphate, filtered and excess solvent was removed by rotary evaporation under reduced pressure. The resulting residue was subjected to column flash chromatography (silica gel; 50/50 v/v hexane/ethyl acetate). Pure fractions were collected and combined and excess eluent was removed by rotary evaporation under reduced pressure to give the product 59 (334 mg, 65%). LC/MS, 4.18 min (ES+) m/z (relative intensity) 950.50 ([M]+, 100). $^1$H NMR (400 MHz, CDCl$_3$) δ 8.53 (s, 1H), 8.02 (s, 1H), 7.44 (d, J=7.6 Hz, 2H), 7.21 (s, 1H), 7.08 (d, J=8.2 Hz, 2H), 6.72-6.61 (m, J=8.9 Hz, 2H), 6.16 (s, 1H), 5.97-5.79 (m, J=24.4, 7.5 Hz, 2H), 5.41-5.08 (m, 5H), 4.86 (d, J=12.5 Hz, 1H), 4.69-4.60 (m, 1H), 4.57 (s, 1H), 4.03 (t, J=6.7 Hz, 1H), 3.87 (s, 3H), 3.74 (td, J=9.6, 3.6 Hz, 1H), 2.43-2.09 (m, J=34.8, 19.4, 11.7 Hz, 3H), 1.76 (s, 3H), 1.43 (d, J=6.9 Hz, 3H), 1.30-1.21 (m, 3H), 0.97 (d, J=6.7 Hz, 3H), 0.92 (t, J=8.4 Hz, 3H), 0.84 (s, 9H), 0.23 (s, 3H), 0.12 (s, 3H).

(e) (11S,11aS)-4-(2-(1-((1-(Allyloxy)-4-methyl-1,2-dioxopentan-3-yl)amino)-1-oxopropan-2-yl)hydrazinyl)benzyl 11-((tert-butyldimethylsilyl)oxy)-8-hydroxy-7-methoxy-2-methyl-5-oxo-11,11a-dihydro-1H-benzo[e]pyrrolo[1,2-a][1,4]diazepine-10(5H)-carboxylate (60)

Lithium acetate (50 mg, 0.49 mmol) was added to a solution of compound 59 (470 mg, 0.49 mmol) in wet dimethylformamide (4 mL, 50:1 DMF/water). After 4 hours, the reaction was complete and the reaction mixture was diluted with ethyl acetate and washed with citric acid (pH~3), water and brine. The organic layer was dried over magnesium sulphate filtered and excess ethyl acetate was removed by rotary evaporation under reduced pressure. The resulting residue was subjected to column flash chromatography (silica gel; gradient, 50/50 to 25/75 v/v hexane/ethyl acetate). Pure fractions were collected and combined and excess eluent was removed by rotary evaporation under reduced pressure to give the product 60 (400 mg, quantitative). LC/MS, 3.32 min (ES+) m/z (relative intensity) 794.18 ([M+H]+., 100). $^1$H NMR (400 MHz, CDCl$_3$) δ 8.53 (s, 1H), 8.02 (s, 1H), 7.44 (d, J=7.6 Hz, 2H), 7.21 (s, 1H), 7.08 (d, J=8.2 Hz, 2H), 6.72-6.61 (m, J=8.9 Hz, 2H), 6.16 (s, 1H), 5.97-5.79 (m, J=24.4, 7.5 Hz, 2H), 5.41-5.08 (m, 5H), 4.86 (d, J=12.5 Hz, 1H), 4.69-4.60 (m, 1H), 4.57 (s, 1H), 4.03 (t, J=6.7 Hz, 1H), 3.87 (s, 3H), 3.74 (td, J=9.6, 3.6 Hz, 1H), 2.43-2.09 (m, J=34.8, 19.4, 11.7 Hz, 3H), 1.76 (s, 3H), 1.43 (d, J=6.9 Hz, 3H), 1.30-1.21 (m, 3H), 0.97 (d, J=6.7 Hz, 3H), 0.92 (t, J=8.4 Hz, 3H), 0.84 (s, 9H), 0.23 (s, 3H), 0.12 (s, 3H).

(iv) (11S,11aS)-4-((2S,5S)-37-(2,5-dioxo-2,5-dihydro-1H-pyrrol-1-yl)-5-isopropyl-2-methyl-4,7,35-trioxo-10,13,16,19,22,25,28,31-octaoxa-3,6,34-triazaheptatriacontanamido)benzyl 11-hydroxy-7-methoxy-8-((5-(((S)-7-methoxy-2-methyl-5-oxo-5,11a-dihydro-1H-benzo[e]pyrrolo[1,2-a][1,4]diazepin-8-yl)oxy)pentyl)oxy)-2-methyl-5-oxo-11,11a-dihydro-1H-benzo[e]pyrrolo[1,2-a][1,4]diazepine-10(5H)-carboxylate (64)

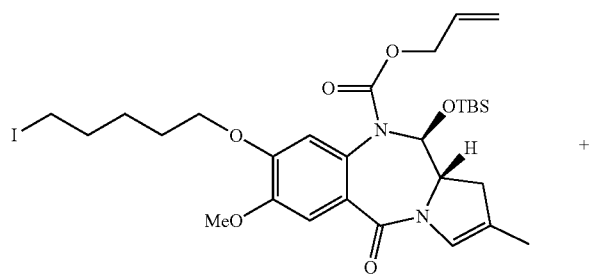

-continued
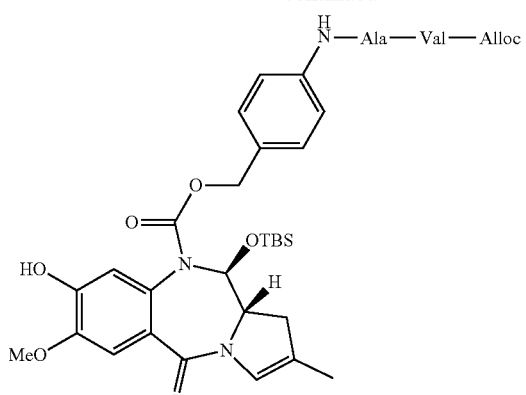
60
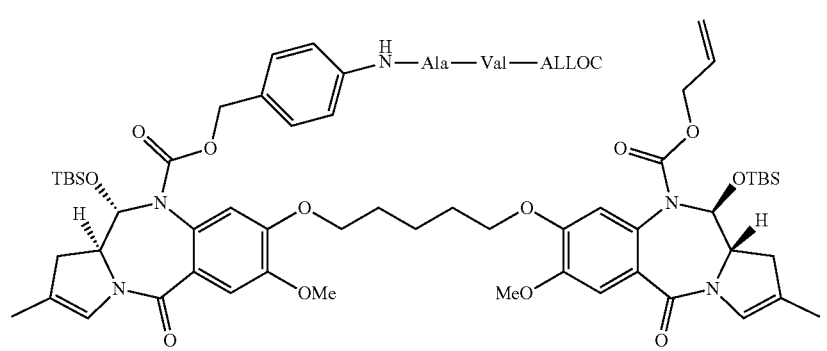
61
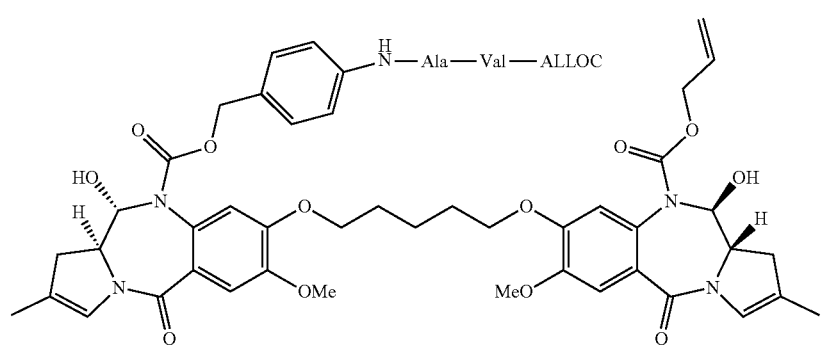
62
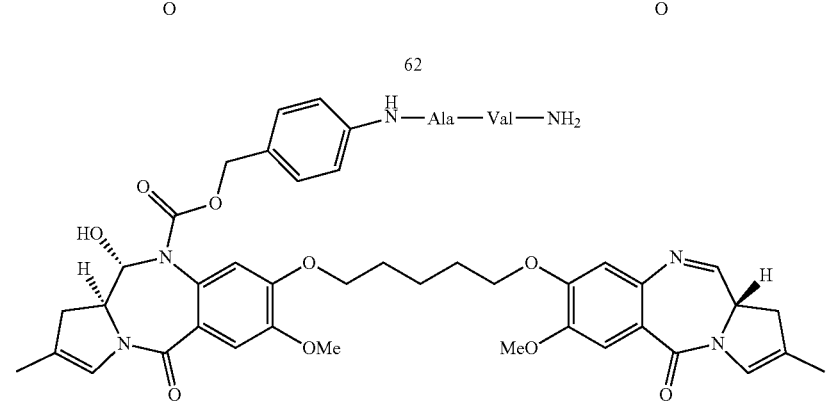
63

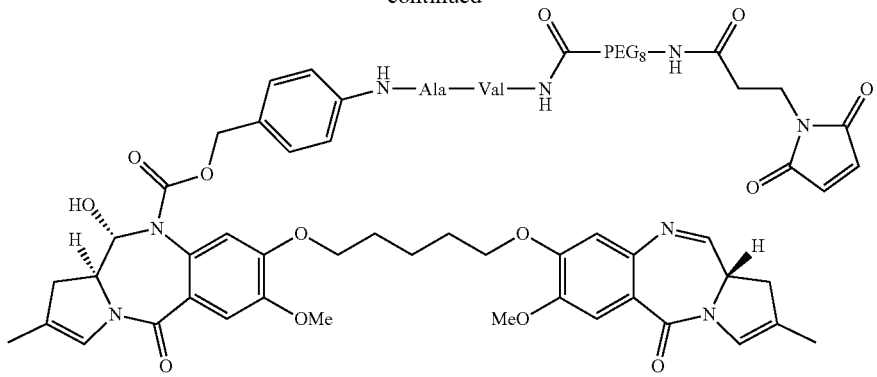

64

(a) (11S)-allyl 8-((5-(((11S)-10-(((4-(2-(1-((1-(allyloxy)-4-methyl-1,2-dioxopentan-3-yl)amino)-1-oxopropan-2-yl)hydrazinyl)benzyl)oxy)carbonyl-11-((tert-butyldimethylsilyl)oxy)-7-methoxy-2-methyl-5-oxo-5,10,11,11a-tetrahydro-1H-benzo[e]pyrrolo[1,2-a][1,4]diazepin-8-yl)oxy)pentyl)oxy)-11-((tert-butyldimethylsilyl)oxy)-7-methoxy-2-methyl-5-oxo-11,11a-dihydro-1H-benzo[e]pyrrolo[1,2-a][1,4]diazepine-10(5H)-carboxylate (61)

Potassium carbonate (70 mg, 0.504 mmol, 1 eq) was added to a solution of 55 (370 mg, 0.552 mmol, 1.2 eq) and phenol 60 (400 mg, 0.504 mmol) in dry acetone (25 mL). The reaction was stirred 8 hours at 70° C. The LC/MS showed that all the starting material was not consumed, so the reaction was allowed to stir overnight at room temperature and stirred for an additional 2 hours the next day. Acetone was removed by rotary evaporation under reduced pressure. The resulting residue was subjected to flash column chromatography (silica gel; 80% ethyl acetate in hexane to 100% ethyl acetate). Pure fractions were collected and combined and excess eluent was removed by rotary evaporation under reduced pressure to give the product 61 (385 mg, 57%). LC/MS, 4.07 min (ES+) m/z (relative intensity) 1336.55 ([M+H]$^+$., 50).

(b) (11 S)-allyl 8-((5-(((11S)-10-(((4-(2-(1-((1-(allyloxy)-4-methyl-1,2-dioxopentan-3-yl)amino)-1-oxopropan-2-yl)hydrazinyl)benzyl)oxy)carbonyl)-11-hydroxy-7-methoxy-2-methyl-5-oxo-5,10,11,11a-tetrahydro-1H-benzo[e]pyrrolo[1,2-a][1,4]diazepin-8-yl)oxy)pentyl)oxy)-11-hydroxy-7-methoxy-2-methyl-5-oxo-11,11a-dihydro-1H-benzo[e]pyrrolo[1,2-a][1,4]diazepine-10(5H)-carboxylate (62)

Tetra-n-butylammonium fluoride (1M, 0.34 mL, 0.34 mmol, 2 eq) was added to a solution of 61 (230 mg, 0.172 mmol) in dry tetrahydrofuran (3 mL). The starting material was totally consumed after 10 minutes. The reaction mixture was diluted with ethyl acetate (30 mL) and washed sequentially with water and brine. The organic phase was dried over magnesium sulphate filtered and excess ethyl acetate removed by rotary evaporation under reduced pressure. The resulting residue 62 was used as a crude mixture for the next reaction. LC/MS, 2.87 min (ES+) m/z (relative intensity) 1108.11 ([M+H]$^+$., 100).

(c) (11 S)-4-(2-(1-((1-amino-3-methyl-1-oxobutan-2-yl)amino)-1-oxopropan-2-yl)hydrazinyl)benzyl 11-hydroxy-7-methoxy-8-((5-((7-methoxy-2-methyl-5-oxo-5,11a-dihydro-1H-benzo[e]pyrrolo[1,2-a][1,4]diazepin-8-yl)oxy)pentyl)oxy)-2-methyl-5-oxo-11,11a-dihydro-1H-benzo[e]pyrrolo[1,2-a][1,4]diazepine-10(5H)-carboxylate (63)

Tetrakis(triphenylphosphine)palladium(0) (12 mg, 0.01 mmol, 0.06 eq) was added to a solution of crude 62 (0.172 mmol) and pyrrolidine (36 μL, 0.43 mmol, 2.5 eq) in dry dichloromethane (10 mL). The reaction mixture was stirred 20 minutes and diluted with dichloromethane and washed sequentially with saturated aqueous ammonium chloride and brine. The organic phase was dried over magnesium sulphate filtered and excess dichloromethane removed by rotary evaporation under reduced pressure. The resulting residue 63 was used as a crude mixture for the next reaction. LC/MS, 2.38 min (ES+) m/z (relative intensity) 922.16 ([M+H]$^+$., 40).

(d) (11S,11aS)-4-((2S,5S)-37-(2,5-dioxo-2,5-dihydro-1H-pyrrol-1-yl)-5-isopropyl-2-methyl-4,7,35-trioxo-10,13,16,19,22,25,28,31-octaoxa-3,6,34-triazaheptatriacontanamido)benzyl 11-hydroxy-7-methoxy-8-((5-(((S)-7-methoxy-2-methyl-5-oxo-5,11a-dihydro-1H-benzo[e]pyrrolo[1,2-a][1,4]diazepin-8-yl)oxy)pentyl)oxy)-2-methyl-5-oxo-11,11a-dihydro-1H-benzo[e]pyrrolo[1,2-a][1,4]diazepine-10(5H)-carboxylate (64 or DL5)

1-ethyl-3-(3'-dimethylaminopropyl)carbodiimide (EDCI, 33 mg, 0.172 mmol) was added to a solution of crude 63 (0.172 mmol) and Mal-(PEG)$_8$-acid (100 mg, 0.172 mmol) in dry dichloromethane (10 mL). The reaction was stirred for 2 hours and the presence of starting material was no longer observed by LC/MS. The reaction was diluted with dichloromethane and washed sequentially with water and brine.

The organic phase was dried over magnesium sulphate filtered and excess dichloromethane removed by rotary evaporation under reduced pressure. The resulting residue was subjected to flash column chromatography (silica gel; 100% chloroform to 10% methanol in chloroform). Pure fractions were collected and combined and excess eluent was removed by rotary evaporation under reduced pressure to give 64 or DL5 (60 mg, 25% over 3 steps).

I. Synthesis of Drug-Linker DL4 (Route 1)

J. Synthesis of Drug-Linker DL4 (Route 2)

The following methods were employed in this Example J. LCMS data were obtained using an Agilent 1200 series LC/MS with an Agilent 6110 quadrupole MS, with Electrospray ionisation. Mobile phase A—0.1% Acetic acid in water. Mobile Phase B—0.1% in acetonitrile. Flow rate of 1.00 ml/min. Gradient from 5% B rising up to 95% B over 3 minutes, remaining at 95% B for 1 minute and then back down to 5% B over 6 seconds. The total run time is 5

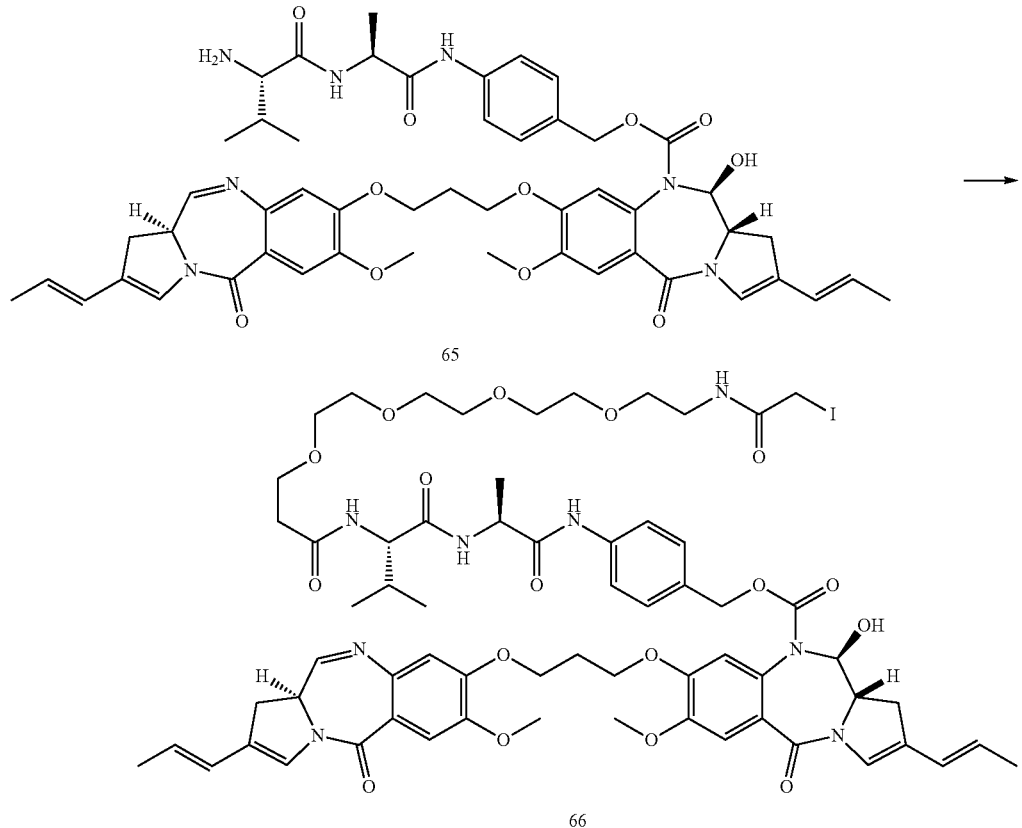

(11 S)-4-(1-iodo-20-isopropyl-23-methyl-2,18,21-trioxo-6,9,12,15-tetraoxa-3,19,22-triazatetracosanamido)benzyl 11-hydroxy-7-methoxy-8-(3-((7-methoxy-5-oxo-2-((E)-prop-1-en-1-yl)-5,11a-dihydro-1H-benzo[e]pyrrolo[1,2-a][1,4]diazepin-8-yl)oxy)propoxy)-5-oxo-2-((E)-prop-1-en-1-yl)-11,11a-dihydro-1H-benzo[e]pyrrolo[1,2-a][1,4]diazepine-10(5H)-carboxylate (66 or DL4)

N,N'-diisopropylcarbodiimide (DIC, 4.71 µL, 0.0304 mmol) was added to a solution of amine 65 (0.0276 mmol) and Iodo-(PEG)$_4$-acid (13.1 mg, 0.0304 mmol) in dry dichloromethane (0.8 mL). The reaction was stirred for 3 hours and the presence of starting material was no longer observed by LC/MS. The reaction mixture was directly loaded onto a thin-layer chromatography (TLC) plate and purified by prep-TLC (10% methanol in chloroform). Pure bands were scraped off the TLC plate, taken up in 10% methanol in chloroform, filtered and excess eluent removed by rotary evaporation under reduced pressure to give 66 (D) (20.9 mg, 56%). LC/MS, method 2, 3.08 min (ES+) m/z (relative intensity) 1361.16 ([M+H]$^+$., 100).

minutes. Column: Phenomenex Gemini-NX 3 µm C18, 30×2.00 mm. Chromatograms based on UV detection at 254 nm. Mass Spectra were achieved using the MS in positive mode. Proton NMR chemical shift values were measured on the delta scale at 400 MHz using a Bruker AV400. The following abbreviations have been used: s, singlet; d, doublet; t, triplet; q, quartet; m, multiplet; br, broad. Coupling constants are reported in Hz. Unless otherwise stated, column chromatography (by the flash procedure) were performed on Merck Kieselgel silica (Art. 9385). Mass spectroscopy (MS) data were collected using a Waters Micromass LCT instrument coupled to a Waters 2795 HPLC separations module. Thin Layer Chromatography (TLC) was performed on silica gel aluminium plates (Merck 60, F$_{254}$). All other chemicals and solvents were purchased from Sigma-Aldrich or Fisher Scientific and were used as supplied without further purification.

Optical rotations were measured on an ADP 220 polarimeter (Bellingham Stanley Ltd.) and concentrations (c) are given in g/100 mL. Melting points were measured using a digital melting point apparatus (Electrothermal). IR spectra were recorded on a Perkin-Elmer Spectrum 1000 FT IR Spectrometer. $^1$H and $^{13}$C NMR spectra were acquired at 300 K using a Bruker Advance NMR spectrometer at 400 and 100 MHz, respectively. Chemical shifts are reported relative to TMS (☐=0.0 ppm), and signals are designated as s (singlet), d (doublet), t (triplet), dt (double triplet), dd (doublet of doublets), ddd (double doublet of doublets) or m (multiplet), with coupling constants given in Hertz (Hz). Mass spectroscopy (MS) data were collected using a Waters Micromass ZQ instrument coupled to a Waters 2695 HPLC with a Waters 2996 PDA. Waters Micromass ZQ parameters used were: Capillary (kV), 3.38; Cone (V), 35; Extractor (V), 3.0; Source temperature (° C.), 100; Desolvation Temperature (° C.), 200; Cone flow rate (L/h), 50; De-solvation flow rate (L/h), 250. High-resolution mass spectroscopy (HRMS) data were recorded on a Waters Micromass QTOF Global in positive W-mode using metal-coated borosilicate glass tips to introduce the samples into the instrument. Thin Layer Chromatography (TLC) was performed on silica gel aluminium plates (Merck 60, $F_{254}$), and flash chromatography utilised silica gel (Merck 60, 230-400 mesh ASTM). Except for the HOBt (NovaBiochem) and solid-supported reagents (Argonaut), all other chemicals and solvents were purchased from Sigma-Aldrich and were used as supplied without further purification. Anhydrous solvents were prepared by distillation under a dry nitrogen atmosphere in the presence of an appropriate drying agent, and were stored over 4 Å molecular sieves or sodium wire. Petroleum ether refers to the fraction boiling at 40-60° C.

General LC/MS conditions: The HPLC (Waters Alliance 2695) was run using a mobile phase of water (A) (formic acid 0.1%) and acetonitrile (B) (formic acid 0.1%). Gradient: initial composition 5% B over 1.0 min then 5% B to 95% B within 3 min. The composition was held for 0.5 min at 95% B, and then returned to 5% B in 0.3 minutes. Total gradient run time equals 5 min. Flow rate 3.0 mL/min, 400 μL was split via a zero dead volume tee piece which passes into the mass spectrometer. Wavelength detection range: 220 to 400 nm. Function type: diode array (535 scans). Column: Phenomenex® Onyx Monolithic C18 50×4.60 mm Initially the following intermediates were prepared.

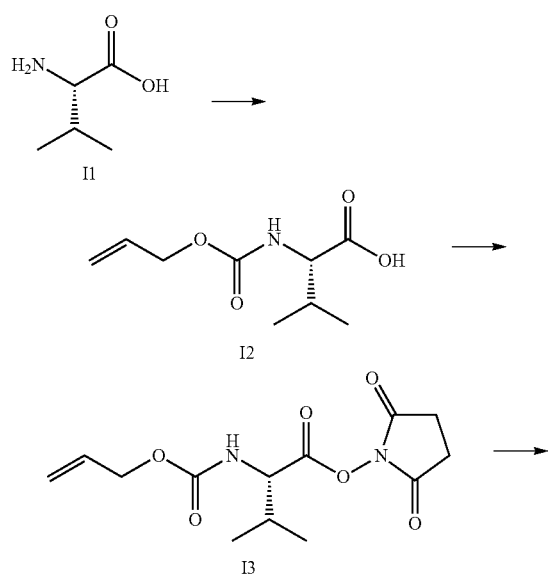

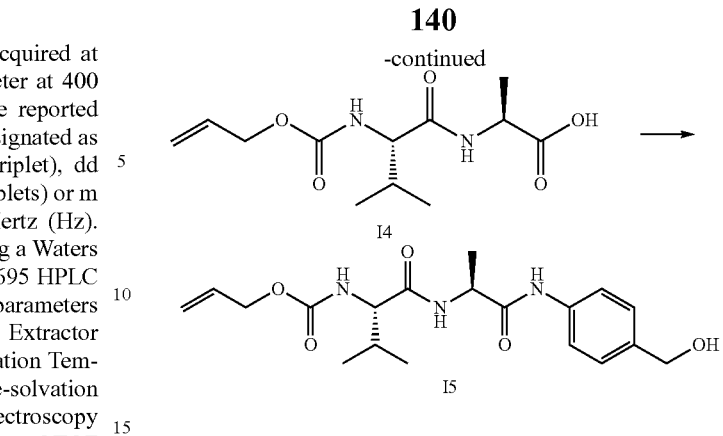

(a-i) (S)-2-(allyloxycarbonylamino)-3-methylbutanoic acid (12)

Allyl chloroformate (36.2 ml, 340.59 mmol, 1.2 eq) was added dropwise to a stirred solution of L-valine (I1)(33.25 g, 283.82 mmol, 1.0 eq) and potassium carbonate (59.27 g, 425.74 mmol, 1.5 eq) in water (650 mL) and THF (650 mL). The reaction mixture was stirred at room temperature for 18 hours, then the solvent was concentrated under reduced pressure and the remaining solution extracted with diethyl ether (3×100 mL). The aqueous portion was acidified to pH 2 with conc. HCl and extracted with DCM (3×100 mL). The combined organics were washed with brine, dried over $MgSO_4$, filtered and concentrated under reduced pressure to afford the product as a colourless oil (57.1 g, assumed 100% yield). LC/MS (1.966 min (ES$^+$)), m/z: 202.1 [M+H]$^+$. $^1$H NMR (400 MHz, DMSO-d$_6$) δ 12.57 (br s, 1H), 7.43 (d, 1H, J=8.6 Hz), 5.96-5.86 (m, 1H), 5.30 (ddd, 1H, J=17.2, 3.4, 1.7 Hz), 5.18 (ddd, 1H, J=10.4, 2.9, 1.6 Hz), 4.48 (dt, 2H, J=5.3, 1.5 Hz), 3.85 (dd, 1H, J=8.6, 6.0 Hz), 2.03 (oct, 1H, J=6.6 Hz), 0.89 (d, 3H, J=6.4 Hz), 0.87 (d, 3H, J=6.5 Hz).

(a-ii) (S)-2,5-dioxopyrrolidin-1-yl 2-(allyloxycarbonylamino)-3-methylbutanoate (13)

To a stirred solution of the protected acid 12 (60.6 g, 301.16 mmol, 1.0 eq) and N-hydroxysuccinimide (34.66 g, 301.16 mmol, 1.0 eq) in dry THF (800 mL) was added dicyclohexylcarbodiimide (62.14 g, 301.16 mmol, 1 eq). The reaction was stirred for 18 hours at room temperature. The reaction mixture was then filtered, the solid washed with THF and the combined filtrate was concentrated under reduced pressure. The residue was re-dissolved in DCM and left to stand at 0° C. for 30 minutes. The suspension was filtered and washed with cold DCM. Concentration of the filtrate under reduced pressure afforded the product as a viscous colourless oil (84.7 g, assumed 100% yield) which was used in the next step without further purification. LC/MS (2.194 min (ES$^+$)), m/z: 321.0 [M+Na]$^+$. $^1$H NMR (400 MHz, DMSO-d$_6$) δ 8.0 (d, 1H, J=8.3 Hz), 5.97-5.87 (m, 1H), 5.30 (ddd, 1H, J=17.2, 3.0, 1.7 Hz), 5.19 (ddd, 1H, J=10.4, 2.7, 1.4 Hz), 4.52 (dt, 2H, J=5.3, 1.4 Hz), 4.32 (dd, 1H, J=8.3, 6.6 Hz), 2.81 (m, 4H), 2.18 (oct, 1H, J=6.7 Hz), 1.00 (d, 6H, J=6.8 Hz), (a-iii) (S)-2-((S)-2-(allyloxycarbonylamino)-3-methylbutanamido)propanoic acid (14)

A solution of succinimide ester 13(12.99 g, 43.55 mmol, 1.0 eq) in THF (50 mL) was added to a solution of L-alanine (4.07 g, 45.73 mmol, 1.05 eq) and NaHCO$_3$ (4.02 g, 47.90 mmol, 1.1 eq) in THF (100 mL) and H$_2$O (100 mL). The mixture was stirred at room temperature for 72 hours when the THF was removed under reduced pressure. The pH was adjusted to 3-4 with citric acid to precipitate a white gum. After extraction with ethyl acetate (6×150 mL), the combined organics were washed with H$_2$O (200 mL), dried over MgSO$_4$, filtered and concentrated under reduced pressure. Trituration with diethyl ether afforded the product as a white powder which was collected by filtration and washed with diethyl ether (5.78 g, 49%).

LC/MS (1.925 min (ES$^+$)), m/z: 273.1 [M+H]$^+$. $^1$H NMR (400 MHz, DMSO-d$_6$) δ 12.47 (br s, 1H), 8.17 (d, 1H, J=6.8 Hz), 7.16 (d, 1H, J=9.0 Hz), 5.95-5.85 (m, 1H), 5.29 (dd, 1H, J=17.2, 1.7 Hz), 5.17 (dd, 1H, J=10.4, 1.5 Hz), 4.46 (m, 2H), 4.18 (quin, 1H, J=7.2 Hz), 3.87 (dd, 1H, J=9.0, 7.1 Hz), 1.95 (oct, 1H, J=6.8 Hz), 1.26 (d, 3H, J=7.3 Hz), 0.88 (d, 3H, J=6.8 Hz), 0.83 (d, 3H, J=6.8 Hz).

(a-iv) Allyl (S)-1-((S)-1-(4-(hydroxymethyl)phenylamino)-1-oxopropan-2-ylamino)-3-methyl-1-oxobutan-2-ylcarbamate (I5)

EEDQ (5.51 g, 22.29 mmol, 1.05 eq) was added to a solution of p-aminobenzyl alcohol (2.74 g, 22.29 mmol, 1.05 eq) and acid 14 (5.78 g, 21.23 mmol, 1 eq) in dry THF (100 mL) and stirred at room temperature for 72 hours. The reaction mixture was then concentrated under reduced pressure and the resulting brown solid was triturated with diethyl ether and filtered with subsequent washing with an excess of diethyl ether to afford the product as an off-white solid (7.1 g, 88%). LC/MS (1.980 min (ES$^+$)), m/z: 378.0 [M+H]$^+$. $^1$H NMR (400 MHz, DMSO-d$_6$) δ 9.89 (br s, 1H), 8.13 (d, 1H, J=7.0 Hz), 7.52 (d, 2H, J=8.5 Hz), 7.26 (m, 1H), 7.23 (d, 2H, J=8.5 Hz), 5.91 (m, 1H), 5.30 (m, 1H), 5.17 (m, 1H), 4.46 (m, 2H), 5.09 (t, 1H, J=5.6 Hz), 4.48 (m, 2H), 4.42 (m, 3H), 3.89 (dd, 1H, J=8.6, 6.8 Hz), 1.97 (m, 1H), 1.30 (d, 3H, J=7.1 Hz), 0.88 (d, 3H, J=6.8 Hz), 0.83 (d, 3H, J=6.7 Hz).

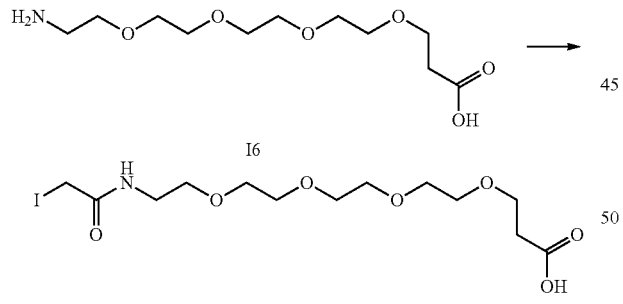

I6

1-iodo-2-oxo-6,9,12,15-tetraoxa-3-azaoctadecan-18-oic acid (17)

A solution of iodoacetic anhydride (0.250 g, 0.706 mmol, 1.1 eq) in dry DCM (1 mL) was added to amino-PEG$_{(4)}$-acid 16 (0.170 g, 0.642 mmol, 1.0 eq) in DCM (1 mL). The mixture was stirred in the dark at room temperature overnight. The reaction mixture was washed with 0.1 M HCl, water, dried over MgSO$_4$, filtered and concentrated under reduced pressure. The residue was purified by flash chromatography (silica gel, 3% MeOH and 0.1% formic acid in chloroform to 10% MeOH and 0.1% formic acid in chloroform) to afford the product as an orange oil (0.118 g, 42%). LC/MS (1.623 min (ES$^+$)), m/z: 433.98 [M+H]$^+$. $^1$H NMR (400 MHz, CDCl$_3$) δ 8.069 (s, 1H), 7.22 (br s, 1H), 3.79 (t, 2H, J=5.8 Hz), 3.74 (s, 2H), 3.72-3.58 (m, 14H), 3.50-3.46 (m, 2H), 2.62 (t, 2H, J=5.8 Hz).

(ii) (11S,11aS)-allyl 11-(tert-butyldimethylsilyloxy)-8-(3-iodopropoxy)-7-methoxy-5-oxo-2-((E)-prop-1-enyl)-11,11a-dihydro-1H-benzo[e]pyrrolo[1,2-a][1,4]diazepine-10(5H)-carboxylate (74)

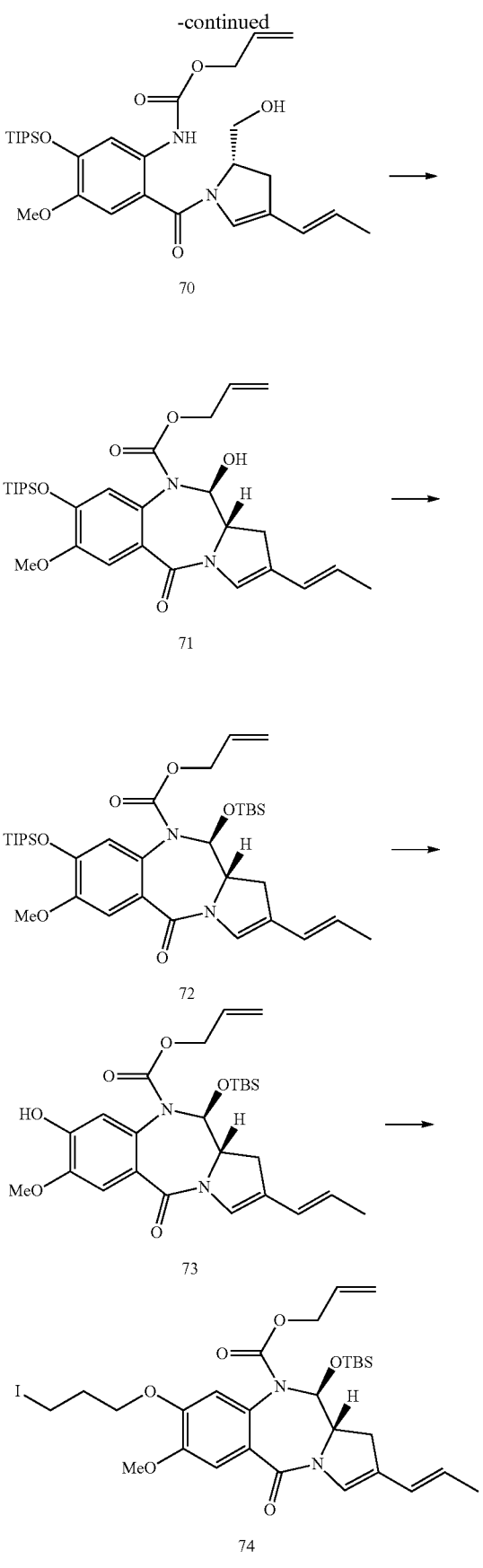

(a) (S)-5-((tert-butyldimethylsilyloxy)methyl)-1-(5-methoxy-2-nitro-4-(triisopropylsilyloxy)benzoyl)-4,5-dihydro-1H-pyrrol-3-yl trifluoromethanesulfonate (47)

Triflic anhydride (28.4 g, 100.0 mmol, 3.0 eq) was added dropwise, over 25 mins, to a vigorously stirred solution of the ketone 46 (19.5 g, 30.0 mmol, 1.0 eq) in DCM (550 mL) containing 2,6-lutidine (14.4 g, 130.0 mmol, 4.0 eq) at −50° C. The reaction mixture was stirred for 1.5 hours when LC/MS indicated complete reaction. The organic phase was washed successively with water (100 mL), saturated sodium bicarbonate (150 mL), brine (50 mL), and the organic phase was dried over MgSO$_4$, filtered and concentrated under reduced pressure. The residue was purified by flash chromatography (silica gel, 90/10 v/v n-hexane/EtOAc) to afford the product as a pale yellow oil (19.5 g, 82%). LC/MS (4.391 min (ES$^+$)), m/z: 713.25 [M+H]$^+$. $^1$H NMR (400 MHz, CDCl$_3$) δ 7.68 (s, 1H), 6.72 (s, 1H), 6.02 (t, 1H, J=1.9 Hz), 4.75 (m, 1H), 4.05 (m, 2H), 3.87 (s, 3H), 3.15 (ddd, 1H, J=16.2, 10.3, 2.3 Hz), 2.96 (ddd, 1H, J=16.2, 4.0, 1.6 Hz), 1.28-1.21 (m, 3H), 1.07 (d, 18H, J=7.2 Hz), 0.88 (s, 9H), 0.09 (s, 3H), 0.08 (s, 3H).

(b) (S,E)-(2-((tert-butyldimethylsilyloxy)methyl)-4-(prop-1-enyl)-2,3-dihydro-1H-pyrrol-1-yl)(5-methoxy-2-nitro-4-(triisopropylsilyloxy)phenyl)methanone (67)

Tetrakis(triphenylphosphine)palladium(0) (0.41 g, 0.35 mmol, 0.03 eq) was added to a mixture of the triflate 47 (8.4 g, 11.8 mmol, 1.0 eq), E-1-propene-1-ylboronic acid (1.42 g, 16.5 mmol, 1.4 eq) and potassium phosphate (5.0 g, 23.6 mmol, 2.0 eq) in dry dioxane (60 mL) under a nitrogen atmosphere. The mixture was stirred at 25° C. for 120 mins when LC/MS indicated complete reaction. Ethyl acetate (120 mL) and water (120 mL) were added, the organic phase was removed, washed with brine (20 mL), dried over MgSO$_4$, filtered and concentrated under reduced pressure. The residue was purified by flash chromatography (silica gel, 95/5 v/v n-hexane/EtOAc to 90/10 v/v n-hexane/EtOAc) to afford the product as a yellow foam (4.96 g, 70%). LC/MS (4.477 min (ES$^+$)), m/z: 605.0 [M+H]$^+$. $^1$H NMR (400 MHz, CDCl$_3$) δ 7.67 (s, 1H), 6.74 (s, 1H), 5.93 (d, 1H, J=15.4 Hz), 5.67 (s, 1H), 4.65 (m, 1H), 4.04 (m, 2H), 3.86 (s, 3H), 2.85 (m, 1H), 2.71 (m, 1H), 1.72 (dd, 3H, J=6.8, 1.0 Hz), 1.30-1.22 (m, 3H), 1.07 (d, 18H, J=7.2 Hz), 0.87 (s, 9H), 0.08 (s, 3H), 0.07 (s, 3H).

(c) (S,E)-(2-amino-5-methoxy-4-(triisopropylsilyloxy)phenyl) (2-((tert-butyldimethylsilyloxy)methyl)-4-(prop-1-enyl)-2,3-dihydro-1H-pyrrol-1-yl)methanone (68)

Zinc dust (22.0 g, 0.33 mol, 37 eq) was added, in portions over 20 mins, to a solution of the propenyl intermediate 67 (5.5 g, 9.1 mmol, 1.0 eq) in 5% v/v formic acid/ethanol (55 mL), using an ice bath to maintain the temperature between 25-30° C. After 30 mins, the reaction mixture was filtered through a short bed of Celite®. The Celite® was washed with ethyl acetate (65 mL) and the combined organics were washed successively with water (35 mL), saturated sodium bicarbonate (35 mL) and brine (10 mL). The organic phase was dried over MgSO$_4$, filtered and concentrated under reduced pressure. The residue was purified by flash chromatography (silica gel, 90/10 v/v n-hexane/EtOAc) to afford the product as a pale yellow oil (3.6 g, 69.0%). LC/MS (4.439 min (ES⁺)), m/z: 575.2 [M+H]⁺. ¹H NMR (400 MHz, CDCl₃) δ 6.75 (m, 1H), 6.40 (br s, 1H), 6.28 (m, 1H), 6.11 (d, 1H, J=15.4 Hz), 5.53 (m, 1H), 4.67 (m, 1H), 4.36 (m, 2H), 3.93 (br s, 1H), 3.84 (br s, 1H), 3.73 (s, 3H), 2.86 (dd, 1H, J=15.7, 10.4 Hz), 2.73 (dd, 1H, J=15.9, 4.5 Hz), 1.80 (dd, 3H, J=6.8, 1.3 Hz), 1.35-1.23 (m, 3H), 1.12 (d, 18H, J=7.3 Hz), 0.89 (s, 9H), 0.08 (s, 3H), 0.07 (s, 3H).

(d) (S,E)-allyl 2-(2-((tert-butyldimethylsilyloxy) methyl)-4-(prop-1-enyl)-2,3-dihydro-1H-pyrrole-1-carbonyl)-4-methoxy-5-(triisopropylsilyloxy)phenyl-carbamate (69)

Allyl chloroformate (0.83 g, 6.88 mmol, 1.1 eq) was added to a solution of the amine 68 (3.6 g, 6.26 mmol, 1.0 eq) in dry DCM (80 mL) containing dry pyridine (1.09 g, 13.77 mmol, 2.2 eq) at −78° C. The dry ice was removed and the reaction mixture allowed to warm to room temperature. After stirring for a further 15 minutes, LC/MS indicated complete reaction. The organic phase was washed successively with 0.01N HCl (50 mL), saturated sodium bicarbonate (50 mL), brine (10 mL), dried over MgSO₄, filtered and concentrated under reduced pressure to leave a pale yellow oil which was used in the next step without further purification (4.12 g, assumed 100% yield). LC/MS (4.862 min (ES⁺)), m/z: 659.2 [M+H]⁺.

(e) (S,E)-allyl 2-(2-(hydroxymethyl)-4-(prop-1-enyl)-2,3-dihydro-1H-pyrrole-1-carbonyl)-4-methoxy-5-(triisopropylsilyloxy)phenylcarbamate (70)

The crude intermediate 69 (assumed 100% yield, 4.12 g, 6.25 mmol, 1.0 eq) was dissolved in a mixture of acetic acid (70 mL), methanol (10 mL), THF (10 mL) and water (20 mL) and allowed to stir at room temperature. After 6 hours the reaction mixture was diluted with ethyl acetate (500 mL) and washed successively with water (2×500 mL), saturated sodium bicarbonate (300 mL) and brine (50 mL). The organic phase was dried over MgSO₄, filtered and concentrated under reduced pressure. The residue was purified by flash chromatography (silica gel, 1/99 v/v methanol/DCM to 5/95 v/v methanol/DCM) to afford the product as a yellow oil and a further 1 g of unreacted starting material was recovered. This material was subjected to the same reaction conditions as above, but was left stirring for 16 h. After work up and purification, additional product was isolated (2.7 g, 79%, 2 steps) LC/MS (3.742 min (ES⁺)), m/z: 545.2 [M+H]⁺. ¹H NMR (400 MHz, CDCl₃) δ 8.38 (m, 1H), 7.72 (m, 1H), 6.81 (s, 1H), 6.37 (m, 1H), 6.10 (d, 1H, J=15.8 Hz), 5.97 (m, 1H), 5.53 (m, 1H), 5.36 (ddd, 1H, J=17.2, 3.1, 1.5 Hz), 5.25 (ddd, 1H, J=10.4, 2.5, 1.3 Hz), 4.78 (m, 1H), 4.65 (dt, 2H, J=5.7, 1.3 Hz), 3.84 (m, 3H), 3.79 (s, 3H), 3.04 (dd, 1H, J=16.7, 10.5 Hz), 2.40 (dd, 1H, J=16.0, 4.5 Hz), 1.82 (dd, 3H, J=6.8, 1.0 Hz), 1.36-1.26 (m, 3H), 1.14 (d, 18H, J=7.3 Hz).

(f) (11S,11aS)-allyl 11-hydroxy-7-methoxy-5-oxo-2-((E)-prop-1-enyl)-8-(triisopropylsilyloxy)-11,11a-dihydro-1H-benzo[e]pyrrolo[1,2-a][1,4]diazepine-10(5H)-carboxylate (71)

Dry dimethyl sulfoxide (1.16 g, 14.87 mmol, 3.0 eq) was added dropwise to a solution of oxalyl chloride (0.94 g, 7.43 mmol, 1.5 eq) in DCM (25 mL) at −78° C. under an atmosphere of nitrogen. Maintaining the temperature at −78° C., after 10 mins a solution of the primary alcohol 70 (2.7 g, 4.96 mmol, 1.0 eq) in DCM (20 mL) was added dropwise. After a further 15 mins, dry triethylamine (2.5 g, 24.78 mmol, 5.0 eq) was added, and the reaction mixture allowed to warm to room temperature. The reaction mixture was washed successively with cold 0.1N HCl (50 mL), saturated sodium hydrogen carbonate (50 mL) and brine (10 mL) and the organic layer was dried over MgSO₄, filtered and concentrated under reduced pressure to afford the product as a yellow oil which was used in the next step without further purification (2.68 g, assumed 100% yield). LC/MS (3.548 min (ES⁺)), m/z: 543.2 [M+H]⁺.

(g) (11S,11aS)-allyl 11-(tert-butyldimethylsilyloxy)-7-methoxy-5-oxo-2-((E)-prop-1-enyl)-8-(triisopropylsilyloxy)-11,11a-dihydro-1H-benzo[e]pyrrolo[1,2-a][1,4]diazepine-10(5H)-carboxylate (72)

Tert-butyldimethylsilyltrifluoromethane sulfonate (3.93 g, 14.87 mmol, 3.0 eq) was added to a solution of the carbinolamine 71 (assumed 100% yield, 2.68 g, 4.96 mmol, 1.0 eq) and 2,6-lutidine (2.12 g, 19.83 mmol, 4.0 eq) in dry DCM (40 mL) at 0° C. under an atmosphere of nitrogen. After 10 minutes, the reaction mixture was allowed to warm to room temperature and stirred for a further 60 minutes. The organic phase was washed successively with water (10 mL), saturated sodium bicarbonate (10 mL) and brine (5 mL), dried over MgSO₄, filtered and concentrated under reduced pressure. The residue was purified by flash chromatography (silica gel, chloroform to 2/98 v/v Methanol/chloroform) to afford the product as a yellow oil (2.0 g, 63%, 2 steps). LC/MS (4.748 min (ES⁺)), m/z: 657.2 [M+H]⁺. ¹H NMR (400 MHz, CDCl₃) δ 7.19 (s, 1H), 6.86 (m, 1H), 6.66 (s, 1H), 6.22 (d, 1H, J=15.4 Hz), 5.81 (d, 1H, J=8.8 Hz), 5.78 (m, 1H), 5.48 (m, 1H), 5.11 (d, 1H, J=5.0 Hz), 5.08 (m, 1H), 4.58 (dd, 1H, J=13.4, 5.4 Hz), 4.35 (dd, 1H, J=13.2, 5.7 Hz), 3.83 (s, 3H), 3.76 (s, 3H), 3.00 (dd, 1H, J=15.6, 11.0 Hz), 2.53 (m, 1H), 1.81 (dd, 3H, J=6.8, 0.9 Hz), 1.30-1.18 (m, 3H), 1.08 (d, 9H, J=2.3 Hz), 1.06 (d, 9H, J=2.3 Hz), 0.86 (s, 9H), 0.25 (s, 3H), 0.18 (s, 3H).

(h) (11S,11aS)-allyl 11-(tert-butyldimethylsilyloxy)-8-hydroxy-7-methoxy-5-oxo-2-((E)-prop-1-enyl)-11,11a-dihydro-1H-benzo[e]pyrrolo[1,2-a][1,4]diazepine-10(5H)-carboxylate (73)

Lithium acetate dihydrate (0.31 g, 3.04 mmol, 1.0 eq) was added to a solution of the diazepine 72 (2.0 g, 3.04 mmol, 1.0 eq) in wet DMF (20 mL) at 25° C. and stirred for 4 hours. The reaction mixture was diluted with ethyl acetate (200 mL) and washed successively with 0.1M citric acid (50 mL, pH 3), water (50 mL) and brine (10 mL), dried over MgSO₄, filtered and concentrated under reduced pressure. The residue was purified by flash chromatography (silica gel, 50/50 v/v n-hexane/EtOAc to 25/75 v/v n-hexane/EtOAc) to afford the product as a pale yellow solid (0.68 g, 45%). LC/MS (3.352 min (ES⁺)), m/z: 501.1 [M+H]⁺. ¹H NMR (400 MHz, CDCl₃) δ 7.02 (s, 1H), 6.66 (m, 1H), 6.53 (s, 1H), 6.03 (d, 1H, J=15.5 Hz), 5.80 (s, 1H), 5.63 (d, 1H, J=8.9 Hz), 5.55 (m, 1H), 5.29 (m, 1H), 4.87 (m, 2H), 4.39 (dd, 1H, J=13.5, 4.2 Hz), 4.20 (dd, 1H, J=13.2, 5.7 Hz), 3.73 (s, 3H), 3.59 (m, 1H), 2.81 (dd, 1H, J=16.1, 10.5 Hz), 2.35 (d, 1H, J=15.7 Hz), 1.61 (d, 3H, J=6.4 Hz), 0.67 (s, 9H), 0.05 (s, 3H), 0.00 (s, 3H).

(i) (11S,11aS)-allyl 11-(tert-butyldimethylsilyloxy)-8-(3-iodopropoxy)-7-methoxy-5-oxo-2-((E)-prop-1-enyl)-11,11a-dihydro-1H-benzo[e]pyrrolo[1,2-a][1,4]diazepine-10(5H)-carboxylate (74)

Diiodopropane (0.295 g, 1.00 mmol, 5.0 eq) and potassium carbonate (0.028 g, 0.20 mmol, 1.0 eq) were added to a solution of the phenol 33 (0.100 g, 0.020 mmol, 1.0 eq) in dry acetone (5 mL). The reaction mixture was heated at 60° C. for 6 hours when LC/MS showed complete reaction. The reaction mixture was concentrated to dryness under reduced pressure and the residue was purified by flash chromatography (silica gel, 75/25 v/v n-hexane/EtOAc to 50/50 v/v n-hexane/EtOAc) to afford the product as a colourless oil (0.074 g, 56%). LC/MS (3.853 min (ES+)), m/z: 669.0 [M+H]+. 1H NMR (400 MHz, CDCl3) δ 7.26 (s, 1H), 6.90 (s, 1H), 6.68 (s, 1H), 6.24 (d, 1H, J=15.3 Hz), 5.87 (d, 1H, J=8.9 Hz), 5.78 (m, 1H), 5.53 (m, 1H), 5.12 (m, 2H), 4.65 (m, 2H), 4.41 (m, 1H), 4.11 (m, 1H), 3.93 (s, 3H), 3.81 (m, 1H), 3.40 (t, 2H, J=6.7 Hz), 3.05 (dd, 1H, J=16.3, 10.1 Hz), 2.57 (m, 1H), 2.34 (m, 2H), 1.84 (d, 3H, J=6.6 Hz), 0.92 (s, 9H), 0.28 (s, 3H), 0.26 (s, 3H).

(iii) (11 S,11aS)-4-((S)-2-((S)-2-(allyloxycarbonylamino)-3-methylbutanamido)propanamido)benzyl 11-(tert-butyldimethylsilyloxy)-8-hydroxy-7-methoxy-5-oxo-2-((E)-prop-1-enyl)-11,11a-dihydro-1H-benzo[e]pyrrolo[1,2-a][1,4]diazepine-10(5H)-carboxylate 79)

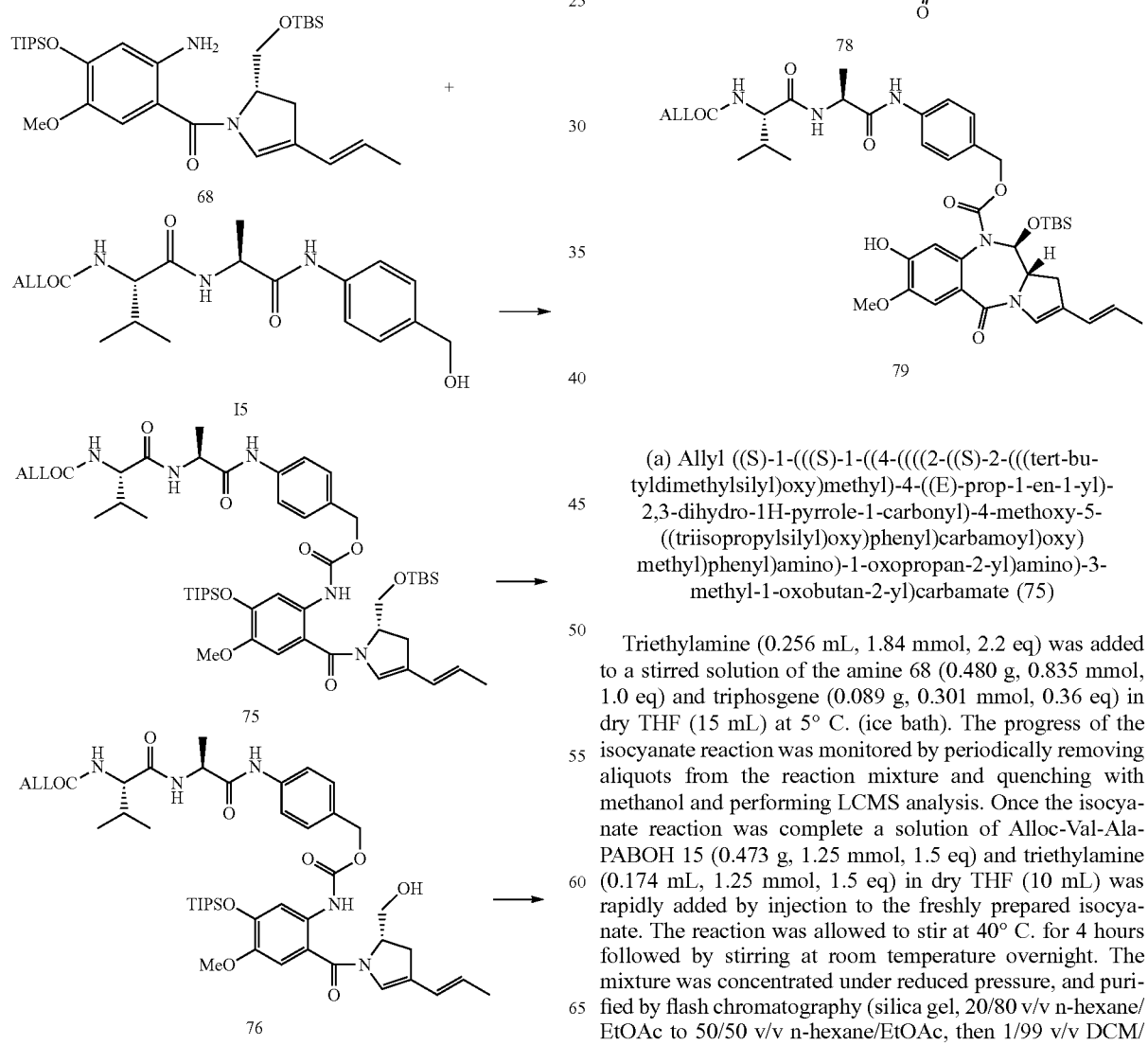

(a) Allyl ((S)-1-(((S)-1-((4-((((2-((S)-2-(((tert-butyldimethylsilyl)oxy)methyl)-4-((E)-prop-1-en-1-yl)-2,3-dihydro-1H-pyrrole-1-carbonyl)-4-methoxy-5-((triisopropylsilyl)oxy)phenyl)carbamoyl)oxy)methyl)phenyl)amino)-1-oxopropan-2-yl)amino)-3-methyl-1-oxobutan-2-yl)carbamate (75)

Triethylamine (0.256 mL, 1.84 mmol, 2.2 eq) was added to a stirred solution of the amine 68 (0.480 g, 0.835 mmol, 1.0 eq) and triphosgene (0.089 g, 0.301 mmol, 0.36 eq) in dry THF (15 mL) at 5° C. (ice bath). The progress of the isocyanate reaction was monitored by periodically removing aliquots from the reaction mixture and quenching with methanol and performing LCMS analysis. Once the isocyanate reaction was complete a solution of Alloc-Val-Ala-PABOH 15 (0.473 g, 1.25 mmol, 1.5 eq) and triethylamine (0.174 mL, 1.25 mmol, 1.5 eq) in dry THF (10 mL) was rapidly added by injection to the freshly prepared isocyanate. The reaction was allowed to stir at 40° C. for 4 hours followed by stirring at room temperature overnight. The mixture was concentrated under reduced pressure, and purified by flash chromatography (silica gel, 20/80 v/v n-hexane/EtOAc to 50/50 v/v n-hexane/EtOAc, then 1/99 v/v DCM/MeOH to 5/95 v/v DCM/MeOH) to afford the product as a yellow solid (0.579 g, 71%). LC/MS (4.468 min (ES⁺)), m/z: 978.55 [M+H]⁺. ¹H NMR (400 MHz, CDCl₃) δ 8.63 (br s, 1H), 8.42 (s, 1H), 7.78 (br s, 1H), 7.53 (d, 2H, J=8.1 Hz), 7.31 (d, 2H, J=8.6 Hz), 6.76 (s, 1H), 6.59 (d, 1H, J=7.6 Hz), 6.36 (br s, 1H), 6.04 (d, 1H, J=15.9 Hz), 5.90 (m, 1H), 5.55 (m, 1H), 5.33-5.21 (m, 3H), 5.10 (s, 2H), 4.66 (m, 2H), 4.57 (dd, 2H, J=5.6, 1.0 Hz), 3.98 (dd, 1H, J=7.3, 6.8 Hz), 3.90 (m, 1H), 3.81 (m, 1H), 3.78 (s, 3H), 2.82 (dd, 1H, J=15.4, 9.6 Hz), 2.72 (dd, 1H, J=15.9, 3.5 Hz), 2.17 (m, 1H), 1.78 (dd, 3H, J=6.5, 0.8 Hz), 1.46 (d, 3H, J=7.1 Hz), 1.29 (m, 3H), 1.11 (d, 18H, J=7.1 Hz), 0.97 (d, 3H, J=6.8 Hz), 0.92 (d, 3H, J=6.8 Hz), 0.83 (s, 9H), 0.04 (s, 3H), 0.01 (s, 3H).

(b) Allyl ((S)-1-(((S)-1-((4-(((((2-((S)-2-(hydroxymethyl)-4-((E)-prop-1-en-1-yl)-2,3-dihydro-1H-pyrrole-1-carbonyl)-4-methoxy-5-((triisopropylsilyl)oxy)phenyl)carbamoyl)oxy)methyl)phenyl)amino)-1-oxopropan-2-yl)amino)-3-methyl-1-oxobutan-2-yl) carbamate (76)

The silyl ether 75 (1.49 g, 1.52 mmol, 1.0 eq) was dissolved in a 7:1:1:2 mixture of acetic acid/methanol/tetrahydrofuran/water (14:2:2:4 mL) and allowed to stir at room temperature. After 2 hours the reaction was diluted with EtOAc (100 mL), washed sequentially with water, aq. sodium bicarbonate then brine. The organic phase was then dried over MgSO₄, filtered and concentrated under reduced pressure. The residue was purified by flash chromatography (silica gel, 100/0 then 99/1 to 92/8 v/v DCM/MeOH) to afford the product as an orange solid (1.2 g, 92%). LC/MS (3.649 min (ES⁺)), m/z: 865.44 [M+H]⁺. ¹H NMR (400 MHz, CDCl₃) δ 8.44 (s, 1H), 8.35 (s, 1H), 7.69 (br s, 1H), 7.53 (d, 2H, J=8.7 Hz), 7.32 (d, 2H, J=8.3 Hz), 6.78 (s, 1H), 6.56 (m, 2H), 6.32 (br s, 1H), 6.05 (d, 1H, J=14.9 Hz), 5.90 (m, 1H), 5.56 (m, 1H), 5.30 (m, 2H), 5.22 (m, 1H), 5.10 (d, 2H, J=3.1 Hz), 4.73 (m, 1H), 4.64 (m, 1H), 4.57 (d, 2H, J=5.8 Hz), 4.01 (m, 1H), 3.79 (m, 2H), 3.76 (s, 3H), 2.98 (dd, 1H, J=16.3, 10.2 Hz), 2.38 (dd, 1H, J=16.6, 4.1 Hz), 2.16 (m, 1H), 1.78 (dd, 3H, J=6.8, 0.9 Hz), 1.46 (d, 3H, J=7.1 Hz), 1.29 (m, 3H), 1.11 (d, 18H, J=7.4 Hz), 0.97 (d, 3H, J=6.7 Hz), 0.92 (d, 3H, J=6.8 Hz).

(c) (11S,11aS)-4-((S)-2-((S)-2-(allyloxycarbonylamino)-3-methylbutanamido)propanamido)benzyl 11-hydroxy-7-methoxy-5-oxo-2-((E)-prop-1-enyl)-8-(triisopropylsilyloxy)-11,11a-dihydro-1H-benzo[e]pyrrolo[1,2-a][1,4]diazepine-10(5H)-carboxylate (77)

Dry dimethyl sulfoxide (0.180 g, 2.3 mmol, 3.0 eq) was added dropwise to a solution of oxalyl chloride (0.147 g, 1.1 mmol, 1.5 eq) in DCM (10 mL) at −78° C. under an atmosphere of nitrogen. Maintaining the temperature at −78° C., after 20 minutes, a solution of the primary alcohol 76 (0.666 g, 0.77 mmol, 1.0 eq) in DCM (10 mL) was added dropwise. After a further 15 minutes, dry triethylamine (0.390 g, 3.85 mmol, 5.0 eq) was added, and the reaction mixture allowed to warm to room temperature. The reaction mixture was washed successively with cold 0.1N HCl (10 mL), saturated sodium hydrogen carbonate (10 mL) and brine (5 mL). The organic layer was then dried over MgSO₄, filtered and concentrated under reduced pressure. The residue was then purified by flash chromatography (silica gel, 50/50 v/v n-hexane/EtOAc to 25/75 v/v n-hexane/EtOAc) to afford the product as a white solid (0.356 g, 54%). LC/MS (3.487 min (ES⁺)), m/z: 862.2 [M+H]⁺. ¹H NMR (400 MHz, CDCl₃) δ 8.34 (br s, 1H), 7.47 (d, 2H, J=7.6 Hz), 7.17 (s, 1H), 7.14 (d, 2H, J=7.5 Hz), 6.86 (br s, 1H), 6.65 (br s, 1H), 6.42 (d, 1H, J=7.6 Hz), 6.22 (d, 1H, J=14.4 Hz), 5.80 (m, 1H), 5.40 (m, 1H), 5.53 (m, 1H), 5.32 (m, 1H), 5.21 (d, 2H, J=9.6 Hz), 5.06 (d, 1H, J=12.3 Hz), 4.90 (m, 1H), 4.58 (m, 3H), 3.98 (m, 1H), 3.84 (m, 1H), 3.81 (s, 3H), 3.50 (m, 1H), 3.05 (dd, 1H, J=16.0, 10.3 Hz), 2.76 (m, 1H), 2.15 (m, 1H), 1.80 (dd, 3H, J=6.7, 0.8 Hz), 1.44 (d, 3H, J=7.1 Hz), 1.16 (m, 3H), 1.01 (d, 18H, J=6.6 Hz), 0.96 (d, 3H, J=6.8 Hz), 0.92 (d, 3H, J=6.8 Hz).

(d) (11S,11aS)-4-((S)-2-((S)-2-(allyloxycarbonylamino)-3-methylbutanamido)propanamido)benzyl 11-(tert-butyldimethylsilyloxy)-7-methoxy-5-oxo-2-((E)-prop-1-enyl)-8-(triisopropylsilyloxy)-11,11a-dihydro-1H-benzo[e]pyrrolo[1,2-a][1,4]diazepine-10 (5H)-carboxylate (78)

Tert-butyldimethylsilyltrifluoromethane sulfonate (0.46 g, 1.74 mmol, 3.0 eq) was added to a solution of secondary alcohol 77 (0.5 g, 0.58 mmol, 1.0 eq) and 2,6-lutidine (0.25 g, 2.32 mmol, 4.0 eq) in dry DCM (10 mL) at 0° C. under an atmosphere of nitrogen. After 10 minutes, the reaction mixture was allowed to warm to room temperature and stirred for a further 120 mins. The organic phase was then washed successively with water (10 mL), saturated sodium bicarbonate (10 mL) and brine (5 mL), dried over MgSO₄, filtered and concentrated under reduced pressure. The residue was purified by flash chromatography (silica gel, 50/50 v/v n-hexane/EtOAc) to afford the product as a white solid (0.320 g, 57%). LC/MS (4.415 min (ES⁺)), m/z: 976.52 [M+H]⁺. ¹H NMR (400 MHz, CDCl₃) δ 8.31 (br s, 1H), 7.48 (d, 2H, J=8.0 Hz), 7.21 (s, 1H), 7.14 (d, 2H, J=8.3 Hz), 6.89 (s, 1H), 6.65 (s, 1H), 6.38 (d, 1H, J=7.3 Hz), 6.25 (d, 1H, J=14.6 Hz), 5.93 (m, 1H), 5.85 (d, 1H, J=8.8 Hz), 5.50 (m, 1H), 5.34 (m, 1H), 5.24 (m, 2H), 5.15 (d, 1H, J=12.5 Hz), 4.86 (d, 1H, J=12.2 Hz), 4.62 (m, 3H), 4.01 (m, 1H), 3.86 (s, 3H), 3.78 (m, 1H), 3.04 (m, 1H), 2.56 (m, 1H), 2.20 (m, 1H), 1.84 (dd, 3H, J=6.6, 0.7 Hz), 1.48 (d, 3H, J=6.8 Hz), 1.20 (m, 3H), 1.05 (d, 9H, J=2.9 Hz), 1.03 (d, 9H, J=2.9 Hz), 0.99 (d, 3H, J=6.8 Hz), 0.95 (d, 3H, J=6.8 Hz), 0.88 (s, 9H), 0.27 (s, 3H), 0.14 (s, 3H).

(e) (11S,11aS)-4-((S)-2-((S)-2-(allyloxycarbonylamino)-3-methylbutanamido)propanamido)benzyl 11-(tert-butyldimethylsilyloxy)-8-hydroxy-7-methoxy-5-oxo-2-((E)-prop-1-enyl)-11,11a-dihydro-1H-benzo[e]pyrrolo[1,2-a][1,4]diazepine-10(5H)-carboxylate (79)

Lithium acetate dihydrate (0.010 g, 0.10 mmol, 1.0 eq) was added to a solution of the silyl ether 78 (0.100 g, 0.10 mmol, 1.0 eq) in wet DMF (2 mL) at 25° C. for 3 hours. The reaction mixture was then diluted with ethyl acetate (20 mL) and washed successively with 0.1M citric acid (20 mL, pH 3), water (20 mL) and brine (5 mL), dried over MgSO₄, filtered and concentrated under reduced pressure. The residue was purified by flash chromatography (silica gel, 5/95 v/v methanol/DCM) to afford the product as a pale yellow oil (0.070 g, 83%). LC/MS (3.362 min (ES⁺)), m/z: 820.2 [M+H]⁺. ¹H NMR (400 MHz, CDCl₃) δ 8.39 (s, 1H), 7.48 (d, 2H, J=8.2 Hz), 7.25 (s, 1H), 7.12 (d, 2H, J=8.1 Hz), 6.88 (s, 1H), 6.68 (s, 1H), 6.47 (d, 1H, J=7.6 Hz), 6.24 (d, 1H, J=15.2 Hz), 6.03 (s, 1H), 5.92 (m, 1H), 5.84 (d, 1H, J=8.9 Hz), 5.50 (m, 1H), 5.34 (m, 1H), 5.26 (m, 2H), 5.18 (d, 1H, J=12.3 Hz), 4.80 (d, 1H, J=12.4 Hz), 4.66-4.60 (m, 3H), 4.02 (m, 1H), 3.95 (s, 3H), 3.81 (m, 1H), 3.03 (m, 1H), 2.57 (m, 1H), 2.19 (m, 1H), 1.84 (dd, 3H, J=6.8, 0.8 Hz), 1.48 (d, 3H, J=7.1 Hz), 1.00 (d, 3H, J=6.8 Hz), 0.95 (d, 3H, J=6.8 Hz), 0.87 (s, 9H), 0.26 (s, 3H), 0.12 (s, 3H).

(iv) (11S,11aS)-4-((20S,23S)-1-iodo-20-isopropyl-23-methyl-2,18,21-trioxo-6,9,12,15-tetraoxa-3,19,22-triazatetracosanamido)benzyl 11-hydroxy-7-methoxy-8-(3-((S)-7-methoxy-5-oxo-2-((E)-prop-1-enyl)-5,11a-dihydro-1H-benzo[e]pyrrolo[1,2-a][1,4]diazepin-8-yloxy)propoxy)-5-oxo-2-((E)-prop-1-enyl)-11,11a-dihydro-1H-benzo[e]pyrrolo[1,2-a][1,4]diazepine-1(5H)-carboxylate (66 or DL4)
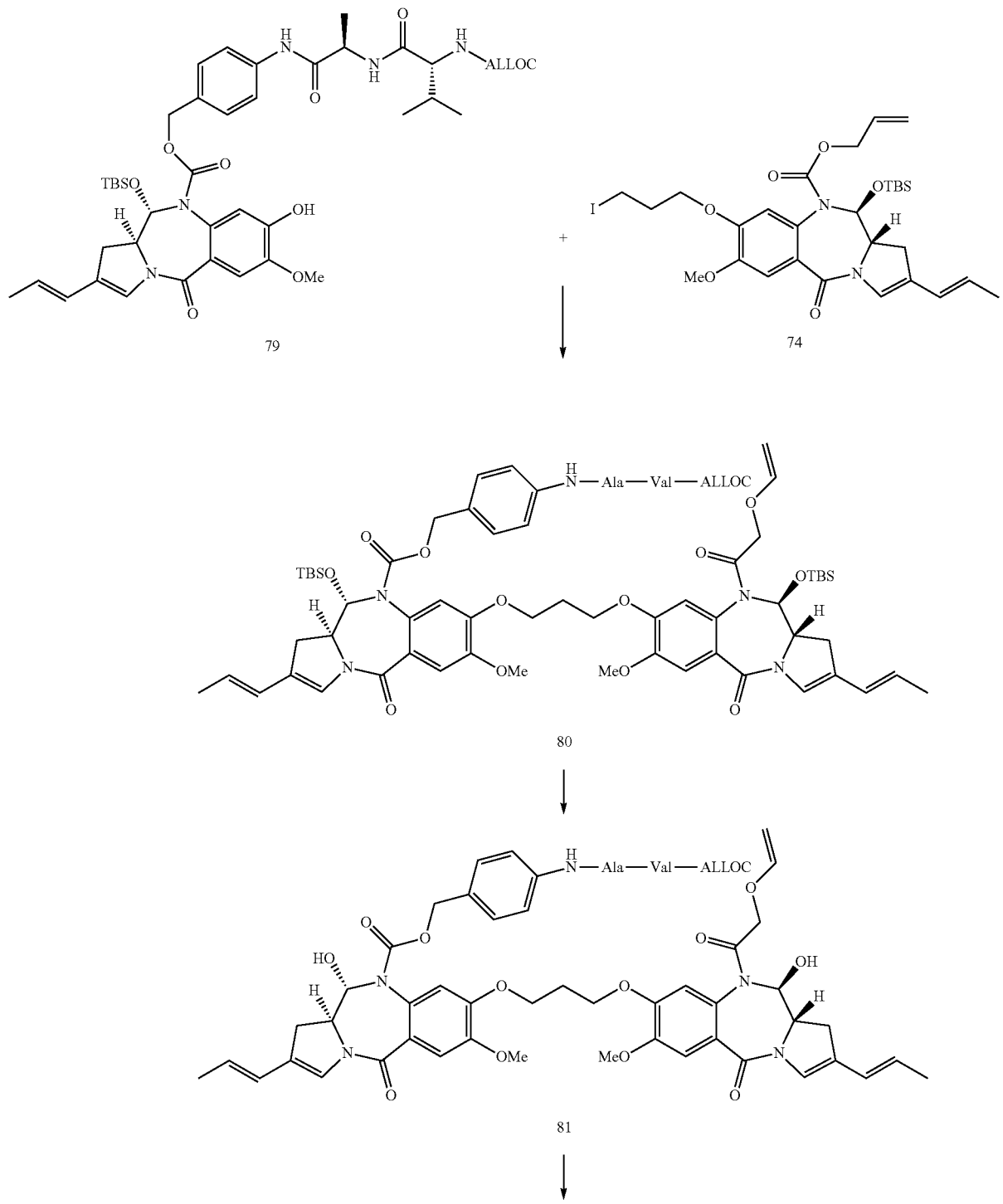

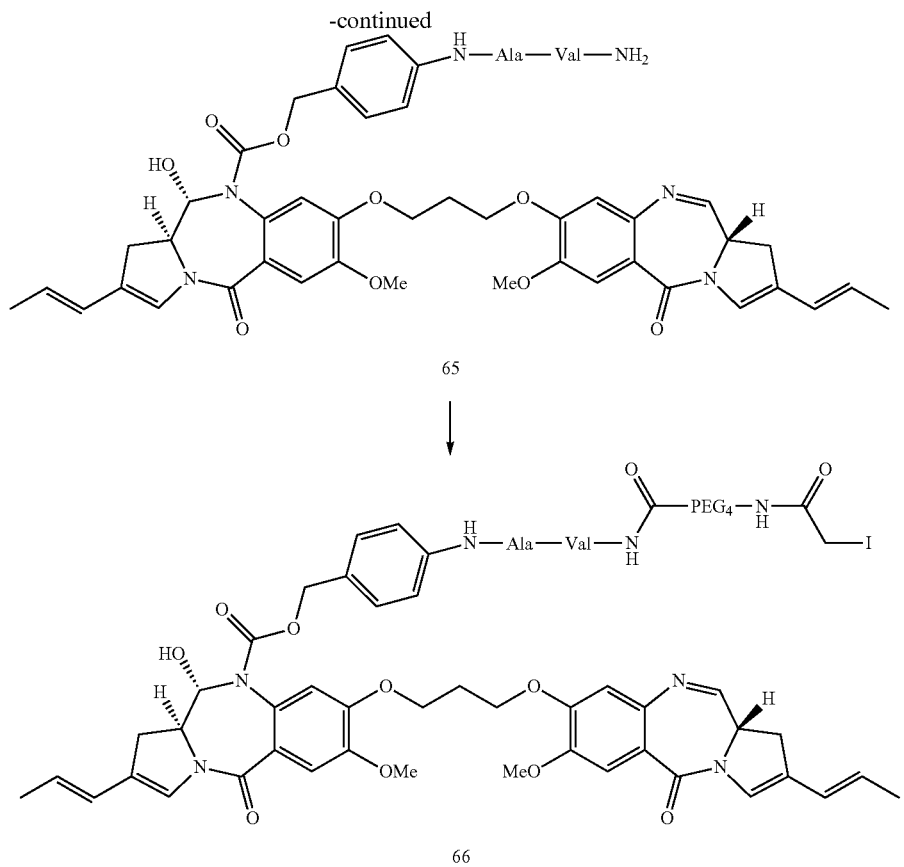

(a) (11S,11aS)-allyl 8-(3-((11S,11aS)-10-((4-((R)-2-((R)-2-(allyloxycarbonylamino)-3-methylbutanamido)propanamido)benzyloxy)carbonyl)-11-(tert-butyldimethylsilyloxy)-7-methoxy-5-oxo-2-((E)-prop-1-enyl)-5,10,11,11a-tetrahydro-1H-benzo[e]pyrrolo[1,2-a][,4]diazepin-8-yloxy)propoxy)-11-(tert-butyldimethylsilyloxy)-7-methoxy-5-oxo-2-((E)-prop-1-enyl)-11,11a-dihydro-1H-benzo[e]pyrrolo[1,2-a][1,4]diazepine-10(5H)-carboxylate (80)

Potassium carbonate (0.030 g, 0.21 mmol, 1.0 eq) was added to a solution of the phenol 79 (0.175 g, 0.21 mmol, 1.0 eq) and the iodo linker 74 (0.214 g, 0.32 mmol, 1.5 eq) in acetone (10 mL). The reaction mixture was heated under a nitrogen atmosphere at 75° C. in a sealed flask for 17 hours. The reaction mixture was concentrated to dryness under reduced pressure and purified by flash chromatography (silica gel, 2/98 v/v methanol/DCM to 5/95 v/v methanol/DCM) to afford the product as a pale yellow solid (0.100 g, 35%). LC/MS (4.293 min (ES$^+$)), m/z: 1359.13 [M]$^+$.

(b) (11S,11aS)-allyl 8-(3-((11S,11aS)-10-((4-((R)-2-((R)-2-(allyloxycarbonylamino)-3-methylbutanamido)propanamido)benzyloxy)carbonyl)-11-hydroxy-7-methoxy-5-oxo-2-((E)-prop-1-enyl)-5,10,11,11a-tetrahydro-1H-benzo[e]pyrrolo[1,2-a][1,4]diazepin-8-yloxy)propoxy)-11-hydroxy-7-methoxy-5-oxo-2-((E)-prop-1-enyl)-11,11a-dihydro-1H-benzo[e]pyrrolo[1,2-a][1,4]diazepine-10(5H)-carboxylate (81)

Tetra-n-butylammonium fluoride (1M, 0.22 mL, 0.22 mmol, 2.0 eq) was added to a solution of silyl ether 80 (0.150 g, 0.11 mmol, 1.0 eq) in dry THF (2 mL). The reaction mixture was stirred at room temperature for 20 minutes, after which LC/MS indicated complete reaction. The reaction mixture was diluted with ethyl acetate (10 mL) and washed sequentially with water (5 mL) and brine (5 mL). The organic phase was dried over MgSO$_4$, filtered and concentrated under reduced pressure to leave a yellow solid. Purification by flash chromatography (silica gel, 6/94 v/v methanol/DCM to 10/90 v/v methanol/DCM) afforded the product as a pale yellow solid (0.090 g, 73%). LC/MS (2.947 min (ES$^+$)), m/z: 1154.0 [M+Na]$^+$. $^1$H NMR (400 MHz, CDCl$_3$) δ 8.39 (br s, 1H), 7.39 (d, 2H, J=7.6 Hz), 7.18 (d, 2H, J=10.6 Hz), 7.10 (m, 3H), 6.86 (d, 2H, J=10.0 Hz), 6.74 (s, 1H), 6.55 (s, 1H), 6.22 (dd, 2H, J=15.3, 6.6 Hz), 5.85 (m, 2H), 5.74 (m, 3H), 5.52 (m, 2H), 5.22 (m, 1H), 5.00 (m, 2H), 4.57 (m, 6H), 4.41 (m, 2H), 4.09 (m, 4H), 3.85 (m, 11H), 3.06 (m, 2H), 2.76 (m, 2H), 2.20 (m, 2H), 2.08 (m, 1H), 1.79 (d, 6H, J=6.4 Hz), 1.40 (d, 3H, J=6.1 Hz), 0.90 (m, 6H).

(c) (11S,11aS)-4-((R)-2-((R)-2-amino-3-methylbutanamido)propanamido)benzyl 11-hydroxy-7-methoxy-8-(3-((S)-7-methoxy-5-oxo-2-((E)-prop-1-enyl)-5,1a-dihydro-1H-benzo[e]pyrrolo[1,2-a][1,4]diazepin-8-yloxy)propoxy)-5-oxo-2-((E)-prop-1-enyl)-11,11a-dihydro-1H-benzo[e]pyrrolo[1,2-a][1,4]diazepine-10 (5H)-carboxylate (65)

Tetrakis(triphenylphospene)palladium(0) (0.005 g, 0.005 mmol, 0.06 eq) was added to a solution of the bis-carbinolamine 81 (0.090 g, 0.08 mmol, 1.0 eq) and pyrrolidine (16 μL, 0.20 mmol, 2.5 eq) in dry DCM (5 mL). After 20 minutes, the reaction mixture was diluted with DCM (10 mL) and washed sequentially with saturated ammonium chloride (5 mL) and brine (5 mL), dried over MgSO$_4$, filtered and the solvent was removed under reduced pressure to leave the crude product as a pale yellow solid which was used in the next step without further purification (0.075 g, assumed 100% yield). LC/MS (2.060 min (ES$^+$)), m/z: 947.2 [M+H]$^+$.

(d) (11S,11aS)-4-((20S,23S)-1-iodo-20-isopropyl-23-methyl-2,18,21-trioxo-6,9,12,15-tetraoxa-3,19,22-triazatetracosanamido)benzyl 11-hydroxy-7-methoxy-8-(3-((S)-7-methoxy-5-oxo-2-((E)-prop-1-enyl)-5,11a-dihydro-1H-benzo[e]pyrrolo[1,2-a][1,4]diazepin-8-yloxy)propoxy)-5-oxo-2-((E)-prop-1-enyl)-11,11a-dihydro-1H-benzo[e]pyrrolo[1,2-a][1,4]diazepine-10(5H)-carboxylate (66 or DL4)

EDCI (0.015 g, 0.08 mmol, 1.0 eq) was added to a solution of amine 65 (assumed 100% yield 0.075 g, 0.08 mmol, 1.0 eq) and iodoacetamide-PEG$_4$-acid 17 (0.034 g, 0.08 mmol, 1.0 eq) in dry dichloromethane (5 mL) and the reaction was stirred in the dark. After 50 minutes, a further amount of iodoacetamide-PEG$_4$-acid 17 (0.007 g, 0.016 mmol, 0.2 eq) was added along with a further amount of EDCI (0.003 g, 0.016 mmol, 0.2 eq). After a total of 2.5 hours, the reaction mixture was diluted with dichloromethane (15 mL) and washed sequentially with water (10 mL) and brine (10 mL). The organic phase was dried over MgSO$_4$, filtered and concentrated under reduced pressure. The resulting residue was purified by flash chromatography (silica gel, Chloroform 100% to 90:10 v/v Chloroform: Methanol). Pure fractions were combined to afford the product (0.0254 g, 23%, 2 steps). The crude fractions were collected and purified by preparative TLC (silica gel, 90:10 v/v Chloroform:Methanol) to afford a second batch of product (0.0036 g, 3%, 2 steps). LC/MS (2.689 min (ES$^+$)), m/z: 681.0½[M+2H]$^+$.

It will be appreciated that the compounds synthesized in this Example 1 may be conjugated with anti-DLL3 antibodies as disclosed herein to provide the disclosed ADCs 1-5.

Example 2

Generation of Anti-DLL3 Antibodies

Anti-DLL3 murine antibodies were produced as follows. In a first immunization campaign, three mice (one from each of the following strains: Balb/c, CD-1, FVB) were inoculated with human DLL3-fc protein (hDLL3-Fc) emulsified with an equal volume of TiterMax® or alum adjuvant. The hDLL3-Fc fusion construct was purchased from Adipogen International (Catalog No. AG-40A-0113). An initial immunization was performed with an emulsion of 10 µg hDLL3-Fc per mouse in TiterMax. Mice were then boosted biweekly with 5 µg hDLL3-Fc per mouse in alum adjuvant. The final injection prior to fusion was with 5 µg hDLL3-Fc per mouse in PBS.

In a second immunization campaign six mice (two each of the following strains: Balb/c, CD-1, FVB), were inoculated with human DLL3-His protein (hDLL3-His), emulsified with an equal volume of TiterMax® or alum adjuvant. Recombinant hDLL3-His protein was purified from the supernatants of CHO—S cells engineered to overexpress hDLL3-His. The initial immunization was with an emulsion of 10 µg hDLL3-His per mouse in TiterMax. Mice were then boosted biweekly with 5 µg hDLL3-His per mouse in alum adjuvant. The final injection was with 2×10$^5$ HEK-293T cells engineered to overexpress hDLL3.

Solid-phase ELISA assays were used to screen mouse sera for mouse IgG antibodies specific for human DLL3. A positive signal above background was indicative of antibodies specific for DLL3. Briefly, 96 well plates (VWR International, Cat. #610744) were coated with recombinant DLL3-His at 0.5 g/ml in ELISA coating buffer overnight. After washing with PBS containing 0.02% (v/v) Tween 20, the wells were blocked with 3% (w/v) BSA in PBS, 200 µL/well for 1 hour at room temperature (RT). Mouse serum was titrated (1:100, 1:200, 1:400, and 1:800) and added to the DLL3 coated plates at 50 µL/well and incubated at RT for 1 hour. The plates are washed and then incubated with 50 µL/well HRP-labeled goat anti-mouse IgG diluted 1:10,000 in 3% BSA-PBS or 2% FCS in PBS for 1 hour at RT. Again the plates were washed and 40 µL/well of a TMB substrate solution (Thermo Scientific 34028) was added for 15 minutes at RT. After developing, an equal volume of 2N H$_2$SO$_4$ was added to stop substrate development and the plates were analyzed by spectrophotometer at OD 450.

Sera-positive immunized mice were sacrificed and draining lymph nodes (popliteal, inguinal, and medial iliac) were dissected and used as a source for antibody producing cells. Cell suspensions of B cells (approximately 229×10$^6$ cells from the hDLL3-Fc immunized mice, and 510×10$^6$ cells from the hDLL3-His immunized mice) were fused with non-secreting P3x63Ag8.653 myeloma cells at a ratio of 1:1 by electro cell fusion using a model BTX Hybrimmune System (BTX Harvard Apparatus). Cells were re-suspended in hybridoma selection medium consisting of DMEM medium supplemented with azaserine, 15% fetal clone I serum, 10% BM Condimed (Roche Applied Sciences), 1 mM nonessential amino acids, 1 mM HEPES, 100 IU penicillin-streptomycin, and 50 µM 2-mercaptoethanol, and were cultured in four T225 flasks in 100 mL selection medium per flask. The flasks were placed in a humidified 37° C. incubator containing 5% CO$_2$ and 95% air for six to seven days.

On day six or seven after the fusions the hybridoma library cells were collected from the flasks and plated at one cell per well (using the FACSAria I cell sorter) in 200 µL of supplemented hybridoma selection medium (as described above) into 64 Falcon 96-well plates, and 48 96-well plates for the hDLL3-His immunization campaign. The rest of the library was stored in liquid nitrogen.

The hybridomas were cultured for 10 days and the supernatants were screened for antibodies specific to hDLL3 using flow cytometry performed as follows. 1×10$^5$ per well of HEK-293T cells engineered to overexpress human DLL3, mouse DLL3 (pre-stained with dye), or cynomolgus DLL3 (pre-stained with Dylight800) were incubated for 30 minutes with 25 µL hybridoma supernatant. Cells were washed with PBS/2% FCS and then incubated with 25 µL per sample DyeLight 649 labeled goat-anti-mouse IgG, Fc fragment specific secondary diluted 1:300 in PBS/2% FCS. After a 15 minute incubation cells were washed twice with PBS/2% FCS and re-suspended in PBS/2% FCS with DAPI and analyzed by flow cytometry for fluorescence exceeding that of cells stained with an isotype control antibody. Remaining unused hybridoma library cells were frozen in liquid nitrogen for future library testing and screening.

The hDLL3-His immunization campaign yielded approximately 50 murine anti-hDLL3 antibodies and the hDLL3-Fc immunization campaign yielded approximately 90 murine anti-hDLL3 antibodies.

Example 3

Sequencing of Anti-DLL3 Antibodies

Based on the foregoing, a number of exemplary distinct monoclonal antibodies that bind immobilized human DLL3 or h293-hDLL3 cells with apparently high affinity were selected for sequencing and further analysis. As shown in a tabular fashion in FIGS. 3A and 3B, sequence analysis of the light chain variable regions (FIG. 3A) and heavy chain variable regions (FIG. 3B) from selected monoclonal antibodies generated in Example 2 confirmed that many had novel complementarity determining regions and often displayed novel VDJ arrangements. Note that the complementarity determining regions and framework regions set forth in FIGS. 3A and 3B are defined as per Kabat et al. (supra) using a proprietary version of the Abysis database.

Initially selected hybridoma cells expressing the desired antibodies were lysed in Trizol® reagent (Trizol® Plus RNA Purification System, Life Technologies) to prepare the RNA encoding the antibodies. Between $10^4$ and $10^5$ cells were re-suspended in 1 mL Trizol and shaken vigorously after addition of 200 µL chloroform. Samples were then centrifuged at 4° C. for 10 minutes and the aqueous phase was transferred to a fresh microfuge tube and an equal volume of 70% ethanol was added. The sample was loaded on an RNeasy Mini spin column, placed in a 2 mL collection tube and processed according to the manufacturer's instructions. Total RNA was extracted by elution, directly to the spin column membrane with 100 µL RNase-free water. The quality of the RNA preparations was determined by fractionating 3 µL in a 1% agarose gel before being stored at −80° C. until used.

The variable region of the Ig heavy chain of each hybridoma was amplified using a 5' primer mix comprising 32 mouse specific leader sequence primers designed to target the complete mouse $V_H$ repertoire in combination with a 3' mouse Cγ primer specific for all mouse Ig isotypes. Similarly, a primer mix containing thirty two 5' Vκ leader sequences designed to amplify each of the Vκ mouse families was used in combination with a single reverse primer specific to the mouse kappa constant region in order to amplify and sequence the kappa light chain. For antibodies containing a lambda light chain, amplification was performed using three 5' $V_L$ leader sequences in combination with one reverse primer specific to the mouse lambda constant region. The $V_H$ and $V_L$ transcripts were amplified from 100 ng total RNA using the Qiagen One Step RT-PCR kit as follows. A total of eight RT-PCR reactions were run for each hybridoma, four for the Vκ light chain and four for the Vγ heavy chain. PCR reaction mixtures included 3 µL of RNA, 0.5 µL of 100 µM of either heavy chain or kappa light chain primers (custom synthesized by Integrated Data Technologies), 5 µL of 5×RT-PCR buffer, 1 µL dNTPs, 1 µL of enzyme mix containing reverse transcriptase and DNA polymerase, and 0.4 µL of ribonuclease inhibitor RNasin (1 unit). The thermal cycler program was RT step 50° C. for 30 minutes, 95° C. for 15 minutes followed by 30 cycles of (95° C. for 30 seconds, 48° C. for 30 seconds, 72° C. for 1 minute). There was then a final incubation at 72° C. for 10 minutes.

The extracted PCR products were sequenced using the same specific variable region primers as described above for the amplification of the variable regions. To prepare the PCR products for direct DNA sequencing, they were purified using the QIAquick™ PCR Purification Kit (Qiagen) according to the manufacturer's protocol. The DNA was eluted from the spin column using 50 µL of sterile water and then sequenced directly from both strands. Nucleotide sequences were analyzed using the IMGT sequence analysis tool (http://www.imgt.org/IMGTmedical/sequence_analysis.html) to identify germline V, D and J gene members with the highest sequence homology. The derived sequences were compared to known germline DNA sequences of the Ig V- and J-regions by alignment of $V_H$ and $V_L$ genes to the mouse germline database using a proprietary antibody sequence database.

More specifically, FIG. 3A depicts the contiguous amino acid sequences of numerous novel murine light chain variable regions from anti-DLL3 antibodies and exemplary humanized light chain variable regions derived from representative murine light chains. Similarly, FIG. 3B depicts the contiguous amino acid sequences of numerous novel murine heavy chain variable regions from the same anti-DLL3 antibodies and exemplary humanized heavy chain variable regions derived from the same murine antibodies providing the humanized light chains. Murine light and heavy chain variable region amino acid sequences are provided in SEQ ID NOS: 21-387, odd numbers while humanized light and heavy chain variable region amino acid sequences are provided in SEQ ID NOS: 389-407, odd numbers.

Thus, taken together FIGS. 3A and 3B provide the annotated sequences of a number of operable murine anti-DLL3 antibodies (termed SC16.3, SC16.4, SC16.5, SC16.7, SC16.8, SC16.10, SC16.11, SC16.13, SC16.15, SC16.18, SC16.19, SC16.20, SC16.21, SC16.22, SC16.23, SC16.25, SC16.26, SC16.29, SC16.30, SC16.31, SC16.34, SC16.35, SC16.36, SC16.38, SC16.41, SC16.42, SC16.45, SC16.47, SC16.49, SC16.50, SC16.52, SC16.55, SC16.56, SC16.57, SC16.58, SC16.61, SC16.62, SC16.63, SC16.65, SC16.67, SC16.68, SC16.72, SC16.73, SC16.78, SC16.79, SC16.80, SC16.81, SC16.84, SC16.88, SC16.101, SC16.103, SC16.104, SC16.105, SC16.106, SC16.107, SC16.108, SC16.109, SC16.110, SC16.111, SC16.113, SC16.114, SC16.115, SC16.116, SC16.117, SC16.118, SC16.120, SC16.121, SC16.122, SC16.123, SC16.124, SC16.125, SC16.126, SC16.129, SC16.130, SC16.131, SC16.132, SC16.133, SC16.134, SC16.135, SC16.136, SC16.137, SC16.138, SC16.139, SC16.140, SC16.141, SC16.142, SC16.143, SC16.144, SC16.147, SC16.148, SC16.149 and SC16.150) and exemplary humanized antibodies (termed hSC16.13, hSC16.15, hSC16.25, hSC16.34 and hSC16.56). Note that these same designations may refer to the clone that produces the subject antibody and, as such, the use of any particular designation should be interpreted in the context of the surrounding disclosure.

For the purposes of the instant application the SEQ ID NOS of each particular antibody are sequential odd numbers. Thus mAb SC16.3 comprises amino acid SEQ ID NOS: 21 and 23 for the light and heavy chain variable regions respectively. In this regard SC16.4 comprises SEQ ID NOS: 25 and 27, SC16.5 comprises SEQ ID NOS: 29 and 31, and so on. The corresponding nucleic acid sequence for each antibody amino acid sequence is included in the appended sequence listing and has the SEQ ID NO immediately preceding the corresponding amino acid SEQ ID NO. Thus, for example, the SEQ ID NOS of the $V_L$ and $V_H$ of the SC16.3 antibody are 21 and 23, respectively, and the SEQ ID NOS of the nucleic acid sequences of the $V_L$ and $V_H$ of the SC16.3 antibody are SEQ ID NOS: 20 and 22, respectively.

With regard to the reported sequences it should be noted that, due to sequencing anomalies, certain heavy and light chain variable region sequences were prematurely truncated during the procedure. This resulted in the omission of one or more amino acids in the reported framework 4 sequence. In such cases compatible amino acids (determined by review of corresponding sequences from other clones) have been supplied to essentially complete the subject variable region sequence. For example, the residues "IK" were added to the terminal end of the SC16.22 light chain sequence in FIG. 3A (SEQ ID NO: 73) to provide an operable light chain variable region with a complete framework 4. Bases encoding the added amino acids were similarly added to the corresponding nucleic acid sequence (SEQ ID NO: 72) to ensure consistency. In each such case in FIGS. 3A and 3B (but not in the appended sequence listing) the added amino acids are underlined and bolded so as to be readily identifiable.

Example 4

Generation of Chimeric and Humanized Anti-DLL3 Antibodies

As alluded to above certain murine antibodies from Example 2 (SC16.13, SC16.15, SC16.25, SC16.34 and SC16.56) were used to derive chimeric antibodies comprising human constant regions with murine variable regions and humanized antibodies comprising murine CDRs grafted into a human acceptor antibody. In preferred embodiments these derived antibodies (chimeric or humanized) may be incorporated in the disclosed DLL3 conjugates.

More specifically chimeric anti-DLL3 antibodies were generated using art-recognized techniques as follows. Total RNA was extracted from the hybridomas and amplified as set forth in Example 3. Data regarding V, D and J gene segments of the $V_H$ and $V_L$ chains of the murine antibodies was obtained from the derived nucleic acid sequences. Primer sets specific to the leader sequence of the $V_H$ and $V_L$ chain of the antibody were designed using the following restriction sites: AgeI and XhoI for the $V_H$ fragments, and XmaI and DraIII for the $V_L$ fragments. PCR products were purified with a Qiaquick PCR purification kit (Qiagen), followed by digestion with restriction enzymes AgeI and XhoI for the $V_H$ fragments and XmaI and DraIII for the $V_L$ fragments. The $V_H$ and $V_L$ digested PCR products were purified and ligated, respectively, into a human IgG1 (SEQ ID NO. 6) heavy chain constant region expression vector or a kappa $C_L$ (SEQ ID NO. 5) human light chain constant region expression vector.

The ligation reactions were performed as follows in a total volume of 10 µL with 200U T4-DNA Ligase (New England Biolabs), 7.5 µL of digested and purified gene-specific PCR product and 25 ng linearized vector DNA. Competent *E. coli* DH10B bacteria (Life Technologies) were transformed via heat shock at 42° C. with 3 µL ligation product and plated onto ampicillin plates at a concentration of 100 µg/mL. Following purification and digestion of the amplified ligation products, the $V_H$ fragment was cloned into the AgeI-XhoI restriction sites of the pEE6.4HuIgG1 expression vector (Lonza) and the $V_L$ fragment was cloned into the XmaI-DraIII restriction sites of the pEE12.4Hu-Kappa expression vector (Lonza).

Chimeric antibodies were expressed by co-transfection of HEK-293T cells with pEE6.4HuIgG1 and pEE12.4Hu-Kappa expression vectors. Prior to transfection the HEK-293T cells were cultured in 150 mm plates under standard conditions in Dulbecco's Modified Eagle's Medium (DMEM) supplemented with 10% heat inactivated FCS, 100 µg/mL streptomycin and 100 U/mL penicillin G. For transient transfections cells were grown to 80% confluency. 12.5 µg each of pEE6.4HuIgG1 and pEE12.4Hu-Kappa vector DNA were added to 50 µL HEK-293T transfection reagent in 1.5 mL Opti-MEM. The mix was incubated for 30 minutes at room temperature and plated. Supernatants were harvested three to six days after transfection. Culture supernatants containing recombinant chimeric antibodies were cleared from cell debris by centrifugation at 800×g for 10 minutes and stored at 4° C. Recombinant chimeric antibodies were purified by Protein A affinity chromatography.

The same murine anti-DLL3 antibodies (e.g. SC16.13, SC16.15, SC16.25, SC16.34 and SC16.56) were also used to derive CDR-grafted or humanized antibodies. In this respect the murine antibodies were humanized using a proprietary computer-aided CDR-grafting method (Abysis Database, UCL Business) and standard molecular engineering techniques as follows. Human framework regions of the variable regions were designed based on the highest homology between the framework sequences and CDR canonical structures of human germline antibody sequences, and the framework sequences and CDRs of the relevant mouse antibodies. For the purpose of the analysis the assignment of amino acids to each of the CDR domains was done in accordance with Kabat et al. numbering. Once the variable regions were selected, they were generated from synthetic gene segments (Integrated DNA Technologies). Humanized antibodies were cloned and expressed using the molecular methods described above for chimeric antibodies.

The genetic composition for the selected human acceptor variable regions are shown in TABLE 3 immediately below for each of the humanized antibodies. The sequences depicted in TABLE 3 correspond to the annotated heavy and light chain sequences set forth in FIGS. 3A and 3B for the subject clones. More specifically, the entries in TABLE 3 below correspond to the contiguous variable region sequences set forth SEQ ID NOS: 389 and 391 (hSC16.13), SEQ ID NOS: 393 and 395 (hSC16.15), SEQ ID NOS: 397 and 399 (hSC16.25), SEQ ID NOS: 401 and 403 (hSC16.34) and SEQ ID NOS: 405 and 407 (hSC16.56). Besides the genetic composition TABLE 3 shows that, in these selected embodiments, no framework changes or back mutations were necessary to maintain the favorable binding properties of the selected antibodies. Of course, in other CDR grafted constructs it will be appreciated that such framework changes or back mutations may be desirable and as such, are expressly contemplated as being within the scope of the instant invention.

TABLE 3

| mAb | human VH | human DH | human JH | FW changes | human VK | human JK | FW changes |
|---|---|---|---|---|---|---|---|
| hSC16.13 | IGHV2-5*01 | IGHD1-1 | JH6 | None | IGKV1-39*01 | JK1 | None |
| hSC16.15 | IGHV1-46*01 | IGHD2-2 | JH4 | None | IGKV1-13*02 | JK4 | None |

TABLE 3-continued

| mAb | human VH | human DH | human JH | FW changes | human VK | human JK | FW changes |
|---|---|---|---|---|---|---|---|
| hSC16.25 | IGHV2-5*01 | IGHD3-16 | JH6 | None | IGKV6-21*01 | JK2 | None |
| hSC16.34 | IGHV1-3*02 | IGHD3-22 | JH4 | None | IGKV1-27*01 | JK1 | None |
| hSC16.56 | IGHV1-18*01 | IGHD2-21 | JH4 | None | IGKV3-15*01 | JK2 | None |

Though no residues were altered in the framework regions, in one of humanized clones (hSC16.13) mutations were introduced into heavy chain CDR2 to address stability concerns. The binding affinity of the antibody with the modified CDR was checked to ensure that it was equivalent to either the corresponding chimeric or murine antibody.

Following humanization of all selected antibodies by CDR grafting, the resulting light and heavy chain variable region amino acid sequences were analyzed to determine their homology with regard to the murine donor and human acceptor light and heavy chain variable regions. The results, shown in TABLE 4 immediately below, reveal that the humanized constructs consistently exhibited a higher homology with respect to the human acceptor sequences than with the murine donor sequences. More particularly, the murine heavy and light chain variable regions show a similar overall percentage homology to a closest match of human germline genes (85%-93%) compared with the homology of the humanized antibodies and the donor hybridoma protein sequences (74%-83%).

TABLE 4

| mAb | Homology to Human (CDR acceptor) | Homology to Murine Parent (CDR donor) |
|---|---|---|
| hSC16.13 HC | 93% | 81% |
| hSC16.13 LC | 87% | 77% |
| hSC16.15 HC | 85% | 83% |
| hSC16.15 LC | 85% | 83% |
| hSC16.25 HC | 91% | 83% |
| hSC16.25 LC | 85% | 79% |
| hSC16.34 HC | 87% | 79% |
| hSC16.34 LC | 85% | 81% |
| hSC16.56 HC | 87% | 74% |
| hSC16.56 LC | 87% | 76% |

Upon testing, and as will be discussed in more detail below, each of the derived humanized constructs exhibited favorable binding characteristics roughly comparable to those shown by the murine parent antibodies.

Example 5

Characteristics of Anti-DLL3 Antibodies

Various methods were used to analyze the binding and immunochemical characteristics of selected DLL3 antibody modulators generated as set forth above. Specifically, a number of the antibody modulators were characterized as to affinity, kinetics, binning, binding location and cross reactivity with regard to human, cynomolgus, rat and mouse antigen recognition (i.e., using the cells and DLL3 protein constructs) by art-recognized methods including flow cytometry. Affinities and kinetic constants $k_{on}$ and $k_{off}$ of the selected modulators were measured using bio-layer interferometry analysis on a ForteBio RED (ForteBio, Inc.) or surface plasmon resonance using a Biacore 2000 each according to the manufacturer's instructions.

The characterization results are set forth in tabular form in FIG. 5 where it may be seen that the selected modulators generally exhibited relatively high affinities in the nanomolar range and, in many cases, were cross-reactive. FIG. 5 further lists the empirically determined antibody bin as well as the DLL3 domain bound by the subject antibody as determined using yeast mediated antigen fragment expression such as described in more detail in Example 6 immediately below.

As to antibody binning, a ForteBio RED was used per manufacturer's instructions to identify competing antibodies that bound to the same or different bins. Briefly, a reference antibody (Ab1) was captured onto an anti-mouse capture chip, a high concentration of non-binding antibody was then used to block the chip and a baseline was collected. Monomeric, recombinant human DLL3-Flag (Adipogen International) was then captured by the specific antibody (Ab1) and the tip was dipped into a well with either the same antibody (Ab1) as a control or into a well with a different test antibody (Ab2). If additional binding was observed with a new antibody, then Ab1 and Ab2 were determined to be in a different bin. If no further binding occurred, as determined by comparing binding levels with the control Ab1, then Ab2 was determined to be in the same bin. As known in the art this process can be expanded to screen large libraries of unique antibodies using a full row of antibodies representing unique bins in a 96-well plate. In the instant case this binning process showed the screened antibodies bound to at least nine different bins (designated as Bins A though I in FIG. 5) on the DLL3 protein. Based on the apparent size of the DLL3 antigen (where the ECD is approximately 56 kD) and the resolution of the binning methodology employed, it is believed that the nine identified bins represent the majority of the bins present on the DLL3 extracellular antigen.

In addition to evaluating the exemplary modulators as set forth above, flow cytometry was performed in order to confirm that selected SC16 antibody modulators can immunospecifically associate with human DLL3 and to determine whether the same antibodies cross-react with cynomolgus, rat and/or murine DLL3. More particularly the exemplary murine antibodies were analyzed by flow cytometry using a FACSCanto II and 293 cells over-expressing murine, rat, cynomolgus or human DLL3. In some cases, exemplary murine modulators were analyzed by flow cytometry using a FACSCanto II and yeast cells displaying cynomolgus DLL3 using the methods described by Cochran et al. (J Immunol Methods. 287 (1-2):147-158 (2004).

Based on flow cytometry all of the selected antibody modulators were found to bind to human DLL3 over-expressed on 293 cells (data not shown) while a number of the tested antibodies were found to cross-react with cynomolgus and/or murine DLL3 (all antibodies reacting with mouse also reacted with rat). In this regard, and as listed in FIG. 5, it was found that eight out of the thirteen modulators that immunospecifically react with human DLL3 also react with murine (or rat) DLL3. Specifically mAbs SC16.4, SC16.8, SC16.15, SC16.34, SC16.39, SC16.46, SC16.51 and SC16.56 were found to cross-react with murine DLL3 to a greater or lesser extent while mAbs SC16.7, SC16.10, SC16.13, SC16.25 and SC16.65 did not appreciably associate with murine DLL3. Such results are not unexpected given that murine DLL3 is approximately 83% homologous with isoform 2 of human DLL3. It will be appreciated that this cross-reactivity may be advantageously exploited in the context of the instant invention through the use of animal models in drug discovery and development.

Besides the aforementioned assays, humanized constructs hSC16.13, hSC16.15, hSC16.25, hSC16.34 and hSC16.56 from Example 4 were analyzed to determine if the CDR grafting process had appreciably altered their binding characteristics. In this respect the humanized constructs (CDR grafted) were compared with "traditional" chimeric antibodies comprising the murine parent (or donor) heavy and light chain variable domains and a human constant region substantially equivalent to that used in the humanized constructs. With these constructs surface plasmon resonance (SPR) was conducted using a Biacore 2000 (GE Healthcare) to identify any subtle changes in rate constants brought about by the humanization process.

Based on a concentration series of 25 and 12.5 nM of human DLL3 antigen and using a 1:1 Langmuir binding model, the $K_D$ of the SC16.15 antibody binding to human DLL3 antigen was estimated to be 0.2 nM. Similar experiments were then run with the other humanized constructs and chimeric constructs to demonstrate they retain therapeutic affinity values (data not shown). Such results demonstrate that the humanization process had not materially impacted the affinity of the modulators and indicated that they are viable candidates for use in the disclosed DLL3 ADCs.

Example 6

Domain and Epitope Mapping of Anti-DLL3 Antibodies

In order to characterize and position the epitopes that disclosed DLL3 antibody drug conjugates associate with or bind to, domain-level epitope mapping was performed on numerous exemplary antibodies using a modification of the protocol described by Cochran et al., 2004 (supra). Briefly, individual domains of DLL3 comprising specific amino acid sequences were expressed on the surface of yeast, and binding by selected DLL3 antibodies were determined through flow cytometry.

More specifically, yeast display plasmid constructs were created for the expression of the following constructs: DLL3 extracellular domain (amino acids 27-466); DLL1-DLL3 chimera, which consists of the N-terminal region and DSL domain of DLL1 (amino acids 22-225) fused to EGF-like domains 1 through 6 of DLL3 (amino acids 220-466); DLL3-DLL1 chimera, which consists of the N-terminal region and DSL domain of DLL3 (amino acids 27-214) fused to EGF-like domains 1 through 8 of DLL1 (amino acids 222-518); EGF-like domain #1 (amino acids 215-249); EGF-like domain #2 (amino acids 274-310); EGF-like domains #1 and #2 (amino acids 215-310); EGF-like domain #3 (amino acids 312-351); EGF-like domain #4 (amino acids 353-389); EGF-like domain #5 (amino acids 391-427); and EGF-like domain #6 (amino acids 429-465). (For domain information see generally UniProtKB/Swiss-Prot database entry Q9NYJ7 which is incorporated herein by reference. Note that the amino acid numbering is by reference to an unprocessed DLL3 protein with a leader sequence such as set forth in SEQ ID NO. 1). For analysis of the N-terminal region or the EGF domains as a whole, chimeras with the family member DLL1 (DLL1-DLL3 and DLL3-DLL1) were used as opposed to fragments to minimize potential problems with protein folding. Domain-mapped antibodies had previously been shown not to cross react with DLL1 indicating that any binding to these constructs was occurring through association with the DLL3 portion of the construct. These plasmids were transformed into yeast, which were then grown and induced as described in Cochran et al.

To test for binding to a particular construct, 200,000 induced yeast cells expressing the desired construct were washed twice in PBS+1 mg/mL BSA (PBSA), and incubated in 50 μL of PBSA with biotinylated anti-HA clone 3F10 (Roche Diagnostics) at 0.1 μg/mL and either 50 nM purified antibody or 1:2 dilution of unpurified supernatant from hybridomas cultured for 7 days. Cells were incubated for 90 minutes on ice, followed by 2 washes in PBSA. Cells were then incubated in 50 μL PBSA with the appropriate secondary antibodies: for murine antibodies, Alexa 488 conjugated streptavidin, and Alexa 647 conjugated goat anti mouse (both Life Technologies) were added at 1 μg/mL each, and for humanized or chimeric antibodies, Alexa 647 conjugated streptavidin (Life Technologies) and R-phycoerythrin conjugated goat anti human (Jackson Immunoresearch) were added at 1 μg/mL each. After a twenty minute incubation on ice, cells were washed twice with PBSA and analyzed on a FACS Canto II. Antibodies that bound to DLL3-DLL1 chimera were designated as binding to the N-terminal region+DSL. Antibodies that bound specifically to an epitope present on a particular EGF-like domain were designated as binding to its respective domain.

In order to classify an epitope as conformational (e.g., discontinuous) or linear, yeast displaying the DLL3 extracellular domain was heat treated for 30 minutes at 80° C., then washed twice in ice-cold PBSA. Yeast displaying denatured antigen (denatured yeast) were then subjected to the same staining protocol and flow cytometry analysis as described above. Antibodies that bound to both the denatured and native yeast were classified as binding to a linear epitope, whereas antibodies that bound native yeast but not denatured yeast were classified as conformationally specific.

Figure 4:
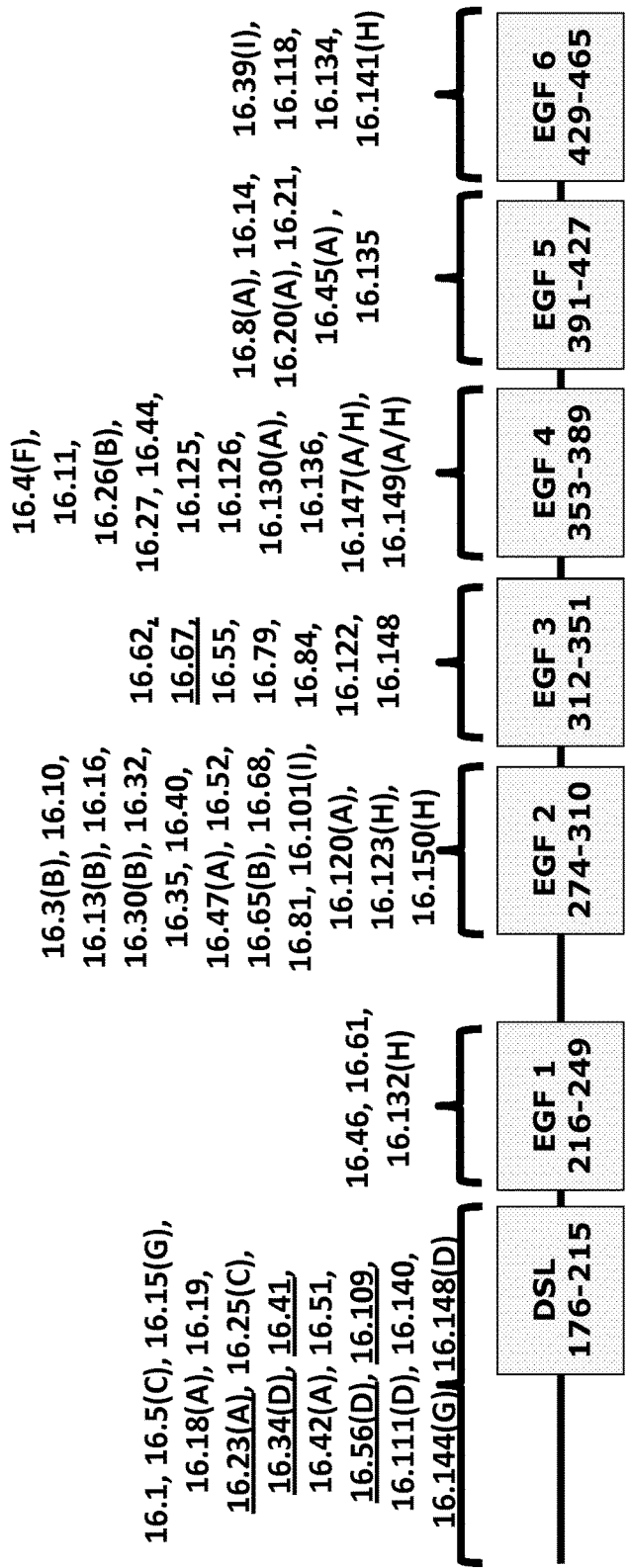
FIG. 4 depicts, in schematic form, the results of domain level mapping analysis of exemplary DLL3 modulators isolated, cloned and engineered as described in the Examples herein.

A schematic summary of the domain-level epitope mapping data of the antibodies tested is presented in FIG. 4, with antibodies binding a linear epitope underlined and, where determined, the corresponding bin noted in parenthesis. A review of FIG. 4 shows that the majority of modulators tended to map to epitopes found either in the N-terminal/DSL region of DLL3 or to the second EGF-like domain. As previously alluded to, FIG. 5 presents similar data regarding bin determination and domain mapping for a number of selected modulators in a tabular form.

Fine epitope mapping was further performed on selected antibodies using one of two methods. The first method employed the Ph.D.-12 phage display peptide library kit (New England Biolabs E8110S) which was used in accordance with the manufacturer's instructions. Briefly, the antibody for epitope mapping was coated overnight at 50 μg/mL in 3 mL 0.1 M sodium bicarbonate solution, pH 8, onto a Nunc MaxiSorp tube (Nunc). The tube was blocked with 3% BSA solution in bicarbonate solution. Then, $10^{11}$ input phage in PBS+0.1% Tween-20 was allowed to bind, followed by ten consecutive washes at 0.1% Tween-20 to wash away non-binding phage. Remaining phage were eluted with 1 mL 0.2 M glycine for 10 minutes at room temperature with gentle agitation, followed by neutralization with 150 μL 1M Tris-HCl pH 9. Eluted phage were amplified and panned again with $10^{11}$ input phage, using 0.5% Tween-20 during the wash steps to increase selection stringency. DNA from 24 plaques of the eluted phage from the second round was isolated using the Qiaprep M13 Spin kit (Qiagen) and sequenced. Binding of clonal phage was confirmed using an ELISA assay, where the mapped antibody or a control antibody is coated onto an ELISA plate, blocked, and exposed to each phage clone. Phage binding was detected using horseradish peroxidase conjugated anti-M13 antibody (GE Healthcare), and the 1-Step Turbo TMB ELISA solution (Pierce). Phage peptide sequences from specifically binding phage were aligned using Vector NTI (Life Technologies) against the antigen ECD peptide sequence to determine the epitope of binding.

Alternatively, a yeast display method (Chao et al., Nat Protoc. 1(2): 755-768, 2007) was used to epitope map select antibodies. Briefly, libraries of DLL3 ECD mutants were generated with error prone PCR using nucleotide analogues 8-oxo-2'deoxyguanosine-5'-triphosphate and 2'-deoxy-p-nucleoside-5'triphosphate (both from TriLink Bio) for a target mutagenesis rate of one amino acid mutation per clone. These were transformed into a yeast display format. Using the technique described above for domain-level mapping, the library was stained for HA and antibody binding at 50 nM. Using a FACS Aria (BD), clones that exhibited a loss of binding compared to wild type DLL3 ECD were sorted. These clones were re-grown, and subjected to another round of FACS sorting for loss of binding to the target antibody. Using the Zymoprep Yeast Plasmid Miniprep kit (Zymo Research), individual ECD clones were isolated and sequenced. Where necessary, mutations were reformatted as single-mutant ECD clones using the Quikchange site directed mutagenesis kit (Agilent).

Individual ECD clones were next screened to determine whether loss of binding was due to a mutation in the epitope, or a mutation that caused misfolding. Mutations that involved cysteine, proline, and stop codons were automatically discarded due to the high likelihood of a misfolding mutation. Remaining ECD clones were then screened for binding to a non-competing, conformationally specific antibody. ECD clones that lost binding to non-competing, conformationally specific antibodies were concluded to contain misfolding mutations, whereas ECD clones that retained equivalent binding to wild type DLL3 ECD were concluded to be properly folded. Mutations in the ECD clones in the latter group were concluded to be in the epitope. The results are listed in TABLE 5 immediately below.

TABLE 5

| Antibody Clone | Epitope | SEQ ID NO: |
|---|---|---|
| SC16.23 | Q93, P94, G95, A96, P97 | 3 |
| SC16.34 | G203, R205, P206 | 4 |
| SC16.56 | G203, R205, P206 | 4 |

More particularly, a summary of selected antibodies with their derived epitopes comprising amino acid residues that are involved in antibody binding are listed in TABLE 5. In this respect antibodies SC16.34 and SC16.56 apparently interact with common amino acid residues which is consistent with the binning information and domain mapping results shown in FIG. 4. Moreover, SC16.23 was found to interact with a distinct contiguous epitope and was found not to bin with SC16.34 or SC16.56.

Example 7

Preparation of DLL3 Antibody Drug Conjugates

To further demonstrate the versatility of the instant invention, anti-DLL3 antibody drug conjugates substantially as set forth in ADCs 1-5 are prepared by conjugating compounds of DL1-DL5 to DLL3 antibodies such as those disclosed herein. In this respect it will be appreciated that, because of the linker chosen for DL4 two slightly different conjugation procedures are employed to provide the disclosed conjugates. More specifically, ADCs 1-3 and 5 are preferably prepared using the first conjugation procedure below and ADC 4 is preferably prepared using the second procedure hereunder.

(a) Maleimido Conjugation

More specifically, DLL3 antibody drug conjugates are prepared comprising linker and pyrrolobenzodiazepine (PBD) dimers set forth in DL1-DL3 and DL5 covalently attached to the disclosed antibodies (see, generally U.S.P.Ns. 2011/0256157 and 2012/0078028 and U.S. Pat. No. 6,214,345 each of which is incorporated herein by reference in its entirety).

The drug-linker combinations of DL1-DL3 and DL5 are synthesized and purified substantially as described in Example 1 above and using art-recognized techniques. Following preparation the drug-linker unit comprising a terminal maleimido moiety is conjugated to a free sulfhydryl on the selected DLL3 antibody. In this regard the DLL3 conjugates are prepared via partial reduction of the selected DLL3 antibody with tris (2-carboxyethyl)-phosphine (TCEP) followed by reaction of reduced Cys residues with the maleimido-linker payload.

More particularly, the selected DLL3 antibody modulator is reduced with 1.3 mol tris(2-carboxyethyl)-phosphine (TCEP) per mol mAb for 90 minutes at 20° C. in 200 mM Tris, pH 7.5 and 32 mM EDTA buffer. The reaction is allowed to cool to 15° C. and the linker payload dissolved in DMA then added at a ratio of 3.2 mol/mol mAb preceded by an additional amount of DMA to a final concentration of 6% (v/v). The reaction is allowed to proceed for 30 minutes. The unreacted drug-linker is capped by addition of an equivalent molar excess of N-Acetyl Cysteine. The conjugates, substantially as set forth in ADCs 1-3 and 5 are then purified by ion exchange column using an AKTA Explorer FPLC system (G.E. Healthcare) to remove aggregated high molecular weight antibody, co-solvent and small molecules. The eluted conjugate is then buffer-exchanged by tangential flow filtration (TFF) into formulation buffer followed by concentration adjustment and addition of a detergent. The final conjugate is analyzed for protein concentration (by measuring UV), aggregation (SEC), drug to antibody ratio (DAR) by reverse phase (RP) HPLC, presence of unconjugated antibody by hydrophobic interaction chromatography (HIC) HPLC, non-proteinaceous materials by RP HPLC and in vitro cytotoxicity using a DLL3 expressing cell line.

(b) Lodoacetamide Conjugation

ADC 4 is prepared substantially as follows. DL4 is synthesized and provided as set forth in Example 1. Following preparation the cytotoxin-linker unit comprising a terminal iodoacetamide moiety is conjugated to a free sulfhydryl on the selected DLL3 antibody. In this regard the DLL3 conjugates are prepared via partial reduction of the selected DLL3 antibody with tris (2-carboxyethyl)-phosphine (TCEP) followed by reaction of reduced Cys residues with the iodoacetamide-linker payload.

More particularly, the selected DLL3 antibody modulator is reduced with 1.8 mol TCEP per mol mAb for 90 minutes at 20° C. in PBS pH 7.2 and 5 mM EDTA buffer. The reduced antibody solution is then adjusted to pH 8.5 with 100 mM sodium borate and the linker payload in DMSO is added at a ratio of at least 5 mol/mol mAb preceded by an additional amount of DMSO to a final concentration of 6% (v/v). The reaction is then allowed to proceed overnight at 20° C. The conjugate is then buffer-exchanged by tangential flow filtration (TFF) into diafiltration buffer followed by concentration adjustment and addition of a detergent. The final conjugate is then analyzed for protein concentration (by measuring UV), aggregation (SEC), drug to antibody ratio (DAR) by reverse phase (RP) HPLC, and in vitro cytotoxicity using a DLL3 expressing cell line.

Using the aforementioned procedures, or substantially similar methodology known in the art, a number of conjugates comprising combinations of various DLL3 antibody modulators and DL moieties are generated and characterized as described herein. In this regard FIG. 6 provides a summary of ADCs that may be generated in accordance with the instant disclosure by conjugating a specific antibody (e.g., SC16.3) with a selected drug-linker (e.g., DL1) to provide the corresponding ADC (i.e., SC16.3-DL1 or SC16.3-ADC1). Those of skill in the art will appreciate that each of the antibody designations in the exemplary constructs of FIG. 6, except those identified as humanized (e.g., hSC16.34-DL4), may represent any type of antibody (chimeric, humanized, human, IgG1, IgG3, etc. versions of the identified murine clones) or immunoreactive fragment thereof. Moreover, it will be appreciated that exemplary ADC 1, ADC 2, ADC 3 and ADC 5 compounds are conjugated using the protocol set forth in Example 7(a) while exemplary ADC 4 compounds are conjugated using the protocol set forth in Example 7(b). It will be appreciated that in selected aspects the present invention comprises a conjugate as set forth in FIG. 6.

Example 8

In Vitro Assay of Tumor Cell Killing Using DLL3 Antibody Drug Conjugates

To demonstrate that DLL3 ADCs of the instant invention are able to mediate the delivery of a cytotoxic agent to live cells, in vitro cell killing assays are performed using selected DLL3 conjugates prepared as per the previous Examples.

DLL3-targeted ADCs armed with one of several PBD payloads (i.e., PBD 1-PBD 5) are evaluated in vitro and bind, with a nanomolar affinity, specifically to DLL3 on human 293 cells engineered to overexpress human DLL3, but not naïve parental 293 cells. To explore the cytotoxic potential of selected ADCs 1-5 in vitro, their ability to kill 293 cells overexpressing human DLL3 is evaluated. Specifically, parental 293T cells or 293T cells engineered to express DLL3 are incubated with dilutions of selected ADCs 1-5 for a period of 48-72 hours prior to assessing cell viability using Cell Titer Glo® (Promega) as per the manufacturer's instructions. ADCs that kill 293 cells overexpressing DLL3 with an IC50 of 0.1-100 pM, but which demonstrate little-to-no ability to kill naïve parental 293 cells, are selected as preclinical candidates.

Based upon the 293 cytotoxicity assays, conjugates are selected for further examination with tumor cells. Initially 2,500 cells/well of human KDY66, a kidney NET NTX expressing endogenous DLL3, are dissociated into a single cell suspension and plated on BD Primaria™ plates (BD Biosciences) in growth factor supplemented serum free media as is known in the art. After a period of 24 hours various concentrations (0.1-100 pM) of purified DLL3 antibody conjugates, for example, SC16.26-DL1, SC16.81-DL2, SC16.118-DL4 and SC16.67-DL5, along with appropriate controls (e.g., non-binding IgG1-DL conjugates) are added to the cultures. After a period of seven days the plates are examined to determine the impact of the DLL3 antibody conjugates on cell viability. The ability of the antibody drug conjugates to internalize and kill tumor cells is determined by enumerating viable cell numbers using Cell Titer Glo® as per the manufacturer's instructions. Raw luminescence counts using cultures containing cells exposed to isotype antibody conjugate controls are set as 100% reference values and all other counts calculated accordingly. It is expected that some or all of the DLL3 conjugates kill KDY66 tumor cells with an IC50 of between 0.1 pM and 100 pM, and that isotype conjugate controls exhibit extremely high IC50 values.

Active DLL3 antibody conjugates are tested in a dilution assay to determine EC50 values for activity. Using the same assay as described immediately above, selected antibody conjugates and appropriate conjugate controls are incubated with plated ovarian tumor cells (e.g., OV26, an ovarian NET NTX tumor). It is expected that some of all of the conjugates show efficient killing of the ovarian tumor cells with measured EC50 values in the picomolar or subpicomolar range. Conversely, control ADCs are expected to exhibit relatively high EC values indicating that they are not effectively internalized and that the conjugated drug remains in an inactive state.

In order to further demonstrate the versatility of the disclosed invention, tumor cells derived from a large cell neuroendocrine lung carcinoma (LU37) are exposed to selected conjugates (e.g., SC16.26-DL1, SC16.81-DL2 and SC16.67-DL5) in accordance with the teachings herein. More specifically, 2,500 LU37 NTX cells per well are plated (BD Primaria™ plates) in growth factor supplemented serum free media one day before the addition of the conjugated DLL3 antibodies and conjugated isotype controls. The plated cells are exposed to various concentrations of the DLL3 conjugates and control conjugates for seven days. Following exposure, cell viability is determined by enumerating viable cell numbers using Cell Titer Glo® as described above. DLL3 conjugates are expected to effectively eliminate tumor cells at clinically relevant concentrations. For example, DLL3 conjugates are expected to possess the ability to kill 50% of the LU37 cells in vitro at concentrations of less than about 100 pM, while isotype control conjugates require concentrations of >1 nM to kill 50% of the tumor cells.

Such results would indicate that the disclosed conjugates are useful for the treatment of a variety of neoplastic disorders.

Example 9

In Vivo Assay of Tumor Growth Suppression Using DLL3 Antibody Drug Conjugates In view of the aforementioned in vitro results, experiments are conducted to assess the ability of the disclosed DLL3 ADCs to shrink and suppress the growth of DLL3 expressing human tumors in vivo. More particularly selected DLL3 conjugates comprising both murine and humanized modulators are tested to demonstrate their ability to suppress human NTX tumor growth in immunodeficient mice.

To prepare for the experiments patient-derived NTX tumors (LU37, LU73, and OV26) are grown subcutaneously in the flanks of female NOD/SCID recipient mice using art-recognized techniques. Tumor volumes and mouse weights are monitored twice weekly. When tumor volumes reach 150-250 mm$^3$, mice are randomly assigned to treatment groups and given injections with various doses of DLL3 conjugates, for example, SC16.21-DL2, SC16.144-DL4, hSC16.34-DL5, hSC16.56-DL1, or isotype controls comprising the same DLs (each produced substantially as described in Example 7 above) via intraperitoneal injection. Mice are given three equal injections of ADCs at 0.1-1 mg/kg, spaced evenly across seven days. Following treatment, tumor volumes and mouse weights are monitored until tumors exceeded 800 mm$^3$ or mice become sick.

To a greater or lesser extent the selected DLL3 conjugates are expected to show the ability to reduce tumor volume or suppress tumor growth. In some instances, it is expected that the tumor growth suppression is enduring, for example, lasting as long as 30 days, 40 days, 50 days, 60 days, or longer. with regard to each of the three different tumor cell lines. The ability of a number of conjugated modulators, including humanized conjugates to retard or suppress tumor growth in vivo for extended periods would further validate use of the disclosed DLL3 conjugates as therapeutic agents for the treatment of proliferative disorders.

Example 10

Assay of Reduction of Cancer Stem Cell Frequency Using DLL3 Antibody Drug Conjugates As set forth in previous Examples the disclosed DLL3 conjugates are expected to be effective in suppressing tumor growth. Moreover, as discussed above, DLL3 expression is associated with cancer stem cells that are generally known to be drug resistant and to fuel tumor recurrence and metastasis. Accordingly, to demonstrate that treatment with DLL3-ADCs reduces the recurrence potential of NTX lines, in vivo limiting dilution assays (LDA) are performed to determine the frequency of cancer stem cells in small cell lung cancer tumors following treatment with DLL3 conjugates, for example, hSC16.13-DL2 or hSC16.34-DL5.

A patient-derived small cell lung cancer xenograft tumor (LU95) and a patient-derived xenograft from a papillary renal cell carcinoma (KDY66) are grown subcutaneously in immunodeficient host mice. When tumor volumes average 150 mm$^3$-250 mm$^3$, the mice are randomly segregated into two groups of seven mice. Via intraperitoneal injection, mice are injected on days 0, 4 and 7, with either human IgG1-DL2 or human IgG1-DL5 (1 mg/kg; n=7 mice each) as negative controls or with DLL3 conjugates, for example, hSC16.13-DL2 or hSC16.34-DL5 (1 mg/kg; n=7 mice each). On day 8, two representative mice from each group (four total) are euthanized and their tumors are harvested and dispersed to single-cell suspensions. It is expected that tumors treated with the isotype control conjugates continue to grow in the five remaining mice while volumes of tumors treated with DLL3 conjugates are reduced to zero or nearly zero in the five remaining mice.

Using standard flow cytometry techniques and a labeled anti-DLL3 antibody, harvested tumors from each of the four treatment groups are assessed to confirm positive DLL3 expression. Tumor cells from each respective treatment group are then pooled and live human cells are isolated by FACS using a FACSAria III (Becton Dickinson) in accordance with the manufacturer's instructions and art-recognized techniques. Briefly, the cells are labeled with FITC conjugated anti-murine H2Kd and anti-murine CD45 antibodies (both BioLegend, Inc.) and then resuspended in 1 µg/ml DAPI. The resulting suspension is then sorted under standard conditions with DAPI$^-$, mH2Kd$^-$ and mCD45$^-$ human cells being collected and the murine cells being discarded.

Cohorts of five recipient mice are then transplanted with either 2000, 500, 120 or 30 sorted live human cells from tumors treated with DLL3 conjugates. For comparison, cohorts of five recipient mice are transplanted with either 1000, 250, 60 or 15 sorted live human cells from tumors treated with the respective isotype conjugate control. Tumors in recipient mice are measured weekly, and individual mice are euthanized before tumors reached 1500 mm$^3$. After the onset of tumor growth, the study is ended after four consecutive weeks without a new tumor appearing in any additional mouse. At that time, recipient mice are scored as positive or negative for tumor growth, with positive growth having volumes exceeding 100 mm$^3$. It is expected that recipients of LU95 or KDY66 cells treated with DLL3 conjugates produce fewer tumors compared to recipients of LU95 or KDY66 cells treated with the DL2 isotype control.

Using Poisson distribution statistics (L-Calc software, Stemcell Technologies), injected cell doses of recipients with and without tumors at 18 weeks post-transplant are used to calculate the frequencies of tumor-initiating cells in each population. The number of TIC per 10,000 live human cells in LU95 or KDY66 samples is expected to be significantly reduced in animals treated with DLL3 conjugates, for example, at least about a 10-fold reduction, or 20-fold reduction, or 50-fold reduction, or 100-fold reduction. The substantial reduction in cancer stem cell frequency would suggest that the modulators of the instant invention may significantly and specifically reduce cancer stem cell populations and, by extension, recurrence, metastasis or re-growth potential tumors.

The complete disclosure of all patents, patent applications, and publications, and electronically available material (including, for example, nucleotide sequence submissions in, e.g., GenBank and RefSeq, and amino acid sequence submissions in, e.g., SwissProt, PIR, PRF, PBD, and translations from annotated coding regions in GenBank and RefSeq cited herein are incorporated by reference. The foregoing detailed description and examples have been given for clarity of understanding only. No unnecessary limitations are to be understood therefrom. The invention is not limited to the exact details shown and described, for variations obvious to one skilled in the art will be included within the invention defined by the claims.

SEQUENCE LISTING (437 sequences)

SEQ ID NO: 1 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 2 - protein, 587 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREA

SEQ ID NO: 3 - protein, 5 aa, Homo sapiens
QPGAP

SEQ ID NO: 4 - protein, 4 aa, Homo sapiens
  misc_feature (2)..(2): Xaa can be any naturally occurring amino acid
GXRP

SEQ ID NO: 5 - protein, 107 aa, Homo sapiens [sequence omitted]

SEQ ID NO: 6 - protein, 329 aa, Homo sapiens
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7-19 - skipped (13 entries)

SEQ ID NO: 20 - DNA, 324 bp, Mus musculus
  misc_feature (1)..(324): SC16.3 VL
  CDS (1)..(324)
caaattgttctcacccagtctccagcaatcatgtctgtatctctaggggaacgggtcaccatgacctgcactgccagctcaagtgtaagttccagttacttgcactggtaccaacaaaagccaggatcctcccccaaactctggatttatagcacatccaacctggcttctggagtcccagctcgcttcagtggcagtgggtctgggacctcttattttttcacaatcagcagcatggaggctgaagatgctgccacttattactgccaccagtatcatcgttccccattcacgttcggcgcggggacaaagttgaaaataaga

SEQ ID NO: 21 - protein, 108 aa, Mus musculus
QIVLTQSPAIMSVSLGERVTMTCTASSSVSSSYLHWYQQKPGSSPKLWIYSTSNLASGVPARFSGSGSGTSYFFTISSMEAEDAATYYCHQYHRSPFTFGAGTKLKIR

SEQ ID NO: 22 - DNA, 369 bp, Mus musculus
  misc_feature (1)..(369): SC16.3 VH
  CDS (1)..(369)
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagccctgaagagccgactaactatctccaaggatacctccagcagccaggtattcctcaagatcgccagtgtggacactgcagatactgccacatactactgtgctcgaatagctgactatggcggagattactatgctatggactactggggtcaaggaacctcagtcaccgtctcctca

SEQ ID NO: 23 - protein, 123 aa, Mus musculus
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIADYGGDYYAMDYWGQGTSVTVSS

SEQ ID NO: 24 - DNA, 321 bp, Mus musculus
  misc_feature (1)..(321): SC16.4 VL
  CDS (1)..(321)
gatatccagatgacacagactacatcttccctgtctgcctctctgggagacagagtcaccatcagttgcagggcaagtcaggacattagcaattatttaaactggtatcagcagaaaccagatggaactgttaaactcctgatctactacacatcaagattacactcaggcgtcccatcaaggttcagtggcagtgggtctggaacagattattctctcaccattagcaacctggagctagaagatattgccacttacttttgccaacagggtgatatgcttccgtggacgttcggtggaggcaccaagctggaaatcaaa

SEQ ID NO: 25 - protein, 107 aa, Mus musculus
DIQMTQTTSSLSASLGDRVTISCRASQDISNYLNWYQQKPDGTVKLLIYYTSRLHSGVPSRFSGSGSGTDYSLTISNLELEDIATYFCQQGDMLPWTFGGGTKLEIK

SEQ ID NO: 26 - DNA, 351 bp, Mus musculus
  misc_feature (1)..(351): SC16.4 VH
  CDS (1)..(351)
cagatccagttggtgcagtctggacctgagctgaagaagcctggagagacagtcaagatctcctgcaaggcttctggttataccttcacagactattcaatgcactgggtgaagcaggctccaggaaagggtttaaagtggatgggctggataaacactgagactggtgagccaggatatgcagatgacttcaagggacggtttgccttctctttggaaacctctgccagcactgcctatttgcagatcaacaacctcaaaaatgaggacacggctacatatttctgtgctcggtacgacgggtatgctatggactattggggtcaaggaacctcagtcaccgtctcctca

SEQ ID NO: 27 - protein, 117 aa, Mus musculus
QIQLVQSGPELKKPGETVKISCKASGYTFTDYSMHWVKQAPGKGLKWMGWINTETGEPGYADDFKGRFAFSLETSASTAYLQINNLKNEDTATYFCARYDGYAMDYWGQGTSVTVSS

SEQ ID NO: 28 - DNA, 318 bp, Mus musculus
  misc_feature (1)..(318): SC16.5 VL
  CDS (1)..(318)
caaattgttctcacccagtctccagcaatcatgtctgcatctccaggggagaaggtcaccatgacctgcagtgccagctcaagtgtaagttacatgcactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggactagaaacccgctcacgttcggggctggaaccaagctggagctgaaa

SEQ ID NO: 29 - protein, 106 aa, Mus musculus
QIVLTQSPAIMSASPGEKVTMTCSASSSVSYMHWYQQKSGTSPKRWIYDTSKLASGVPARFSGSGSGTSYSLTISSMEAEDAATYYCQQWTRNPLTFGAGTKLELK

SEQ ID NO: 30 - DNA, 372 bp, Mus musculus
  misc_feature (1)..(372): SC16.5 VH
  CDS (1)..(372)
caggttactctgaaagagtctggccctgggatattgcagccctcccagaccctcagtctgacttgttctttctctgggttttcactgagcacttctggtatgggtgtaggctggattcgtcagccttcaggagagggtctagagtggctggcagacatttggtgggatgacaataagtactataacccatccctgaagagccggctcacaatctccaaggatacctccagcaaccaggtattcctcaagatcaccagtgtggacactgcagatactgccacttactactgtgctcgaagagttaactatgtttacgacccgtactatgctatggactactggggtcaaggaacctcagtcaccgtctcctca

SEQ ID NO: 31 - protein, 124 aa, Mus musculus
QVTLKESGPGILQPSQTLSLTCSFSGFSLSTSGMGVGWIRQPSGEGLEWLADIWWDDNKYYNPSLKSRLTISKDTSSNQVFLKITSVDTADTATYYCARRVNYVYDPYYAMDYWGQGTSVTVSS

SEQ ID NO: 32 - DNA, 336 bp, Mus musculus
  misc_feature (1)..(336): SC16.7 VL
  CDS (1)..(336)
aacattatgatgacacagtcgccatcatctctggctgtgtctgcaggagaaaaggtcactatgagctgtaagtccagtcaaagtgttttatacagttcaaatcagaagaactacttggcctggtaccaacagaaaccagggcagtctcctaaactgctgatctactgggcatccactagggaatctggtgtccctgatcgcttcacaggcagtggatctgggacagattttactcttaccatcagcactgtacaagttgaagacctggcagtttattactgtcatcaatacctctcctcgtggacgttcggtggaggcaccaagctggaaatcaaa

SEQ ID NO: 33 - protein, 112 aa, Mus musculus
NIMMTQSPSSLAVSAGEKVTMSCKSSQSVLYSSNQKNYLAWYQQKPGQSPKLLIYWASTRESGVPDRFTGSGSGTDFTLTISTVQVEDLAVYYCHQYLSSWTFGGGTKLEIK

SEQ ID NO: 34 - DNA, 357 bp, Mus musculus
  misc_feature (1)..(357): SC16.7 VH
  CDS (1)..(357)
gaggtccagctgcaacagtctggacctgagctggtgaagcctggggcttcagtgaagatttcctgcaaggcttctggttactcattcactggctataaaatgcactgggtgaagcaaagccatgtaaagagccttgagtggattggacgtattaatccttacaatggtgctactagctacaaccagaatttcaaggacaaggccaccttgactgtagataagtcctccagcacagcctacatggacctccacagcctgacatctgaggactctgcagtctatttctgtgcaagaggggactataggtacgactggtttgcttactggggccaagggactctggtcactgtctctgca

SEQ ID NO: 35 - protein, 119 aa, Mus musculus
EVQLQQSGPELVKPGASVKISCKASGYSFTGYKMHWVKQSHVKSLEWIGRINPYNGATSYNQNFKDKATLTVDKSSSTAYMDLHSLTSEDSAVYFCARGDYRYDWFAYWGQGTLVTVSA

SEQ ID NO: 36 - DNA, 321 bp, Mus musculus
  misc_feature (1)..(321): SC16.8 VL
  CDS (1)..(321)
gaaatccagatgacccagtctccatcctctatgtctgcatctctgggagacagaataaccatcacttgccaggcaactcaagacattgttaagaatttaaactggtatcagcagaaaccagggaaacccccttcattcctgatctattatgcaattgaactggcagaaggggtcccatcaaggttcagtggcagtgggtctgggtcagactattctctgacaatcagcaacctggagtctgaagattttgcagactattactgtctacagttttatgagtttccgttcacgttcggtgctgggaccaagctggagctgaaa

SEQ ID NO: 37 - protein, 107 aa, Mus musculus
EIQMTQSPSSMSASLGDRITITCQATQDIVKNLNWYQQKPGKPPSFLIYYAIELAEGVPSRFSGSGSGSDYSLTISNLESEDFADYYCLQFYEFPFTFGAGTKLELK

SEQ ID NO: 38 - DNA, 363 bp, Mus musculus
  misc_feature (1)..(363): SC16.8 VH
  CDS (1)..(363)
caggcccagctgcagcagtctggagctgagctggtaaggcctgggacttcagtgaaggtgtcctgcaaggcttctggatacgccttcactaattacttgatagagtgggtaaagcagaggcctggacagggccttgagtggattggagtgattaatcctggaactggtggtactaactacaatgagaacttcaagggcaaggcaactctgactgcagacaaatcctccagtactgcctacatgcagctcagcagcctgacatctgatgactctgcggtctatttctgtgcaagatccccctatgattaccacgagggtgctatggactactggggtcaaggaacctcagtcaccgtctcctca

SEQ ID NO: 39 - protein, 121 aa, Mus musculus
QAQLQQSGAELVRPGTSVKVSCKASGYAFTNYLIEWVKQRPGQGLEWIGVINPGTGGTNYNENFKGKATLTADKSSSTAYMQLSSLTSDDSAVYFCARSPYDYHEGAMDYWGQGTSVTVSS

SEQ ID NO: 40 - DNA, 324 bp, Mus musculus
  misc_feature (1)..(324): SC16.10 VL
  CDS (1)..(324)
caaattgttctcacccagtctccagcaatcatgtctgcatctctaggggaacgggtcaccatgacctgcactgccagctcaagtgtaagttccagttacttgcactggtaccagcagaagccaggatcatcccccaaactctggatttatagcacttccaacctggcttctggagtcccaactcgcttcagtggcagtgggtctgggacctcttactctctcacaatcagcagcatggaggctgaagatgctgccacttattactgccaccagtatcatcgttccccattcacgttcggctcggggacaaagttggaaataaaa

SEQ ID NO: 41 - protein, 108 aa, Mus musculus
QIVLTQSPAIMSASLGERVTMTCTASSSVSSSYLHWYQQKPGSSPKLWIYSTSNLASGVPTRFSGSGSGTSYSLTISSMEAEDAATYYCHQYHRSPFTFGSGTKLEIK

SEQ ID NO: 42 - DNA, 360 bp, Mus musculus
  misc_feature (1)..(360): SC16.10 VH
  CDS (1)..(360)
caggttactctgaaagagtctggccctgggatattgcagtcctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagtcctgaagagccgactgactatctccaaggatacctccagcagccaggtattcctcaagatcgccagtgtggacactgcagatactgccacatactattgtgctcgattagttgatgatctgtactactttgactactggggccaaggcaccactctcacagtctcctca

SEQ ID NO: 43 - protein, 120 aa, Mus musculus
QVTLKESGPGILQSSQTLSLTCSFSGFSLSTSGMGVGWIRQPSGKGLEWLAHIWWDDVKRYNPVLKSRLTISKDTSSSQVFLKIASVDTADTATYYCARLVDDLYYFDYWGQGTTLTVSS

SEQ ID NO: 44 - DNA, 336 bp, Mus musculus
  misc_feature (1)..(336): SC16.11 VL
  CDS (1)..(336)
gatgttgagatgacccagactccactcactttgtcggttaccattggacaaccagcctccatctcttgcaagtcaagtcagagcctctcagacagtgatggaaagacatatttgaattggatgtttcagaggccaggccggtctccaaagcgcctaatctatctggtgtctaaactggactctggagtccctgacaggttcactggcagtggatcagggacagatttcacactgaaaatcagcagagtggaggctgaggatttgggagtttactattgctggcaaggtaaacattttccgtggacgttcggtggaggcaccaagctggaaatcaaa

SEQ ID NO: 45 - protein, 112 aa, Mus musculus
DVEMTQTPLTLSVTIGQPASISCKSSQSLSDSDGKTYLNWMFQRPGRSPKRLIYLVSKLDSGVPDRFTGSGSGTDFTLKISRVEAEDLGVYYCWQGKHFPWTFGGGTKLEIK

SEQ ID NO: 46 - DNA, 351 bp, Mus musculus
  misc_feature (1)..(351): SC16.11 VH
  CDS (1)..(351)
cagatccagttggtgcagtctggacctgagctgaagaagcctggagagacagtcaagatctcctgcaaggcttctggttataccttcacagactattcaatgcactgggtgaagcaggctccaggaaagggtttaaagtggatgggctggataaacactgagactgttgagccaacatatgcagatgacttcatgggacggtttgccttctctttggaaacctctgccagcactgcctttttgcagatcaacaacctcgaaaatgaggacacggctacatatttctgtgctagatttggttcctatgctatggactactggggtcaaggaacctcagtcaccgtctcctca

SEQ ID NO: 47 - protein, 117 aa, Mus musculus
QIQLVQSGPELKKPGETVKISCKASGYTFTDYSMHWVKQAPGKGLKWMGWINTETVEPTYADDFMGRFAFSLETSASTAFLQINNLENEDTATYFCARFGSYAMDYWGQGTSVTVSS

SEQ ID NO: 48 - DNA, 318 bp, Mus musculus
  misc_feature (1)..(318): SC16.13 VL
  CDS (1)..(318)
caaattgttctcacccagtctccagcactcgtgtctgcatctccaggggagaaggtcaccatgacctgcagtgccagctcaagtgtaagttacatgtactggtaccagcagaaaccaagatcctcccccaaaccctggatttatctcacatccaacctggcttctggagtccctgctcgcttcagtggcagtgggtctgggacctcttactctctcacaatcagcagcatggaggctgaagatgctgccacttattactgccagcagtggcgtagtaacccattcacgttcggctcggggacaaagttggaaataaaa

SEQ ID NO: 49 - protein, 106 aa, Mus musculus
QIVLTQSPALVSASPGEKVTMTCSASSSVSYMYWYQQKPRSSPKPWIYLTSNLASGVPARFSGSGSGTSYSLTISSMEAEDAATYYCQQWRSNPFTFGSGTKLEIK

SEQ ID NO: 50 - DNA, 372 bp, Mus musculus
  misc_feature (1)..(372): SC16.13 VH
  CDS (1)..(372)
caggttactctgaaagagtctggccctgggatattgcagccctcccagaccctcagtctgacttgttctttctctgggttttcactgagcacttctggtatgggtgtaggctggattcggcagccatcagggaagggtctggagtggctggcacacatttggtgggatgatgtcaagcgctataacccagccctgaagagccgactgactatctccaaggatacctccagcagccaggtattcctcaagatcgccagtgtggacactgcagatactgccacatactactgtgctcgcatagtttcctttgataacgacgttgtctctgctatggactactggggtcaaggaacctcagtcaccgtctcctcn

SEQ ID NO: 51 - protein, 124 aa, Mus musculus
  misc_feature (124)..(124): The 'Xaa' at location 124 stands for Ser.
QVTLKESGPGILQPSQTLSLTCSFSGFSLSTSGMGVGWIRQPSGKGLEWLAHIWWDDVKRYNPALKSRLTISKDTSSSQVFLKIASVDTADTATYYCARIVSFDNDVVSAMDYWGQGTSVTVSX

SEQ ID NO: 52 - DNA, 321 bp, Mus musculus
  misc_feature (1)..(321): SC16.15 VL
  CDS (1)..(321)
gacatccagatgactcagtctccagcctccctggctgcatctgtgggagaaactgtcgccatcacatgtcgagcaagtgagaacatttactacaatttagcatggtatcagcagaaacaagggaaatctcctcagctcctgatctatactgcaaacagtttggaagatggtgtcccatcgaggttcagtggcagtggatctgggacacagtattctttgaagatcaacagcatgcagcctgaagattccgcaacttatttctgtaaacaggcttatgacgttcctccgacgttcggtggaggcaccaagctggaaatcaaa

SEQ ID NO: 53 - protein, 107 aa, Mus musculus
DIQMTQSPASLAASVGETVAITCRASENIYYNLAWYQQKQGKSPQLLIYTANSLEDGVPSRFSGSGSGTQYSLKINSMQPEDSATYFCKQAYDVPPTFGGGTKLEIK

SEQ ID NO: 54 - DNA, 351 bp, Mus musculus
  misc_feature (1)..(351): SC16.15 VH
  CDS (1)..(351)
caggtccagcttcagcagtctggggctgaactggcaaaacctggggcctcagtgaagatgtcctgtaaggcttctggctacacctttactcgctactggatacactggataaaacagaggcctggacagggtctggaatggattggatacattaatcctacaactgtttatactgagttcaatcagaacttcaaggacaaggccactttgactgcagacaaatcctccaccacagcctccatgcaactgagcagcctgacatctgaggactctgcagtctattactgtgcaagaggcggtagtaacttctttgactactggggccaaggcaccactctcacagtctcctca

SEQ ID NO: 55 - protein, 117 aa, Mus musculus
QVQLQQSGAELAKPGASVKMSCKASGYTFTRYWIHWIKQRPGQGLEWIGYINPTTVYTEFNQNFKDKATLTADKSSTTASMQLSSLTSEDSAVYYCARGGSNFFDYWGQGTTLTVSS

SEQ ID NO: 56 - DNA, 321 bp, Mus musculus
  misc_feature (1)..(321): SC16.18 VL
  CDS (1)..(321)
gatatccagatgacacagactacatcctccctgtctgcctctttgggagacagagtcaccatcagttgcagggcaagtcagaatattatcaattatttaaactggtatcagcagaagccagatggaactgttaaactcctgatctactacacatcaagattacactcaggagtcccatcaaggttcagtggcagtgggtctgggacagattattctctcaccatcagcaacctggaacctgaagatattgccacttactattgtcaacagtatagtgagcgtccgtacacgttcgggggggggaccaagctggaaataaaa

SEQ ID NO: 57 - protein, 107 aa, Mus musculus
DIQMTQTTSSLSASLGDRVTISCRASQNIINYLNWYQQKPDGTVKLLIYYTSRLHSGVPSRFSGSGSGTDYSLTISNLEPEDIATYYCQQYSERPYTFGGGTKLEIK

SEQ ID NO: 58 - DNA, 351 bp, Mus musculus
  misc_feature (1)..(351): SC16.18 VH
  CDS (1)..(351)
gaagtgaagctggaggagtcaggaggaggcttggtacaacctggagaatccatgaaactctcttgtgctgcttctggattcacttttagtgatgcctggatggactgggtccgccagtctccagagaagggacttgagtgggttgctgaaattagaaacaaagctaataatcatgcaacatattatgctgagtctgtgaaagggaaattcaccatctcaagagatgattccaaaagtagagtgtacctgcaaatgaacaacttaagagctgcagacactggcatttattactgtacggcctatagtaactttgcttactggggccaagggactctggtcactgtctctaca

SEQ ID NO: 59 - protein, 117 aa, Mus musculus
EVKLEESGGGLVQPGESMKLSCAASGFTFSDAWMDWVRQSPEKGLEWVAEIRNKANNHATYYAESVKGKFTISRDDSKSRVYLQMNNLRAADTGIYYCTAYSNFAYWGQGTLVTVST

SEQ ID NO: 60 - DNA, 318 bp, Mus musculus
  misc_feature (1)..(318): SC16.19 VL
  CDS (1)..(318)
gacatccagatgacacagtctccatcctcactgtctgcatctctgggaggcaaagtcaccttcacttgcaaggcaagccaagacattcacaagtatgtagcttggtaccaacacaagcctggaaaaggtcctaggctgctcatacattacacatctacattacagccaggcatctcatcaaggttcagtggaagtgggtctgggagagattattccttcagcatcagcaacctggagcctgaagatattgcaacttattattgtctacagtataataatctgtacacgttcggaggggggaccaagctggaaataaaa

SEQ ID NO: 61 - protein, 106 aa, Mus musculus
DIQMTQSPSSLSASLGGKVTFTCKASQDIHKYVAWYQHKPGKGPRLLIHYTSTLQPGISSRFSGSGSGRDYSFSISNLEPEDIATYYCLQYNNLYTFGGGTKLEIK

SEQ ID NO: 62 - DNA, 354 bp, Mus musculus
  misc_feature (1)..(354): SC16.19 VH
  CDS (1)..(354)
gaggttcagctgcagcagtctggggctgagcttgtgaggccaggggcctcagtcaagttgtcctgcacagcttctggcttcaacattaaagacagccttttgcactgggtgaagcagaggcctgaaaagggcctggagtggattgggtggattgatcctgaggatggtgaaactaaatatgccccgaacttccaggacaaggccactataactacagactcatcctccaacacagcctacctgcaactcatcagcctgacatctgttgacactgccatctattactgtgcctatggtaactacgtgcggcactttgactactggggccaaggcaccactctcacagtctcctca

SEQ ID NO: 63 - protein, 118 aa, Mus musculus
EVQLQQSGAELVRPGASVKLSCTASGFNIKDSLLHWVKQRPEKGLEWIGWIDPEDGETKYAPNFQDKATITTDSSSNTAYLQLISLTSVDTAIYYCAYGNYVRHFDYWGQGTTLTVSS

SEQ ID NO: 64 - DNA, 321 bp, Mus musculus
  misc_feature (1)..(321): SC16.20 VL
  CDS (1)..(321)
gaaatccagatgacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccatcaaggttcagtggcagtgggtctgggtcagactattctctgacaatcaggaacctggagtctgaagactttgcagaccattactgtctacagttttatgagtttccgttcacgttcggtgctgggaccaagctggagctgaaa

SEQ ID NO: 65 - protein, 107 aa, Mus musculus
EIQMTQSPSSMSASLGDRITITCQATQDIVKNLNWYQQKPGKPPSFLIYYATELAEGVPSRFSGSGSGSDYSLTIRNLESEDFADHYCLQFYEFPFTFGAGTKLELK

SEQ ID NO: 66 - DNA, 363 bp, Mus musculus
  misc_feature (1)..(363): SC16.20 VH
  CDS (1)..(363)
caggtccagttgcagcagtctggaactgagctggtaaggcctgggacttcagtgagggtgtcctgcaaggcttctggatacgccttcggtaatcacttgattgagtgggtgaagcagaggcctggacagggccttgagtggattggagtgattaatcctggaactggtggtactcactacaatgagaagttcaaggacaaggcaagactgaccgcagacaaatcctccaacactgcctacatgcacctcaacagcctgacatctgatgactctgcggtctatttctgtgcaagatccccctatgattaccacgagggtgctatggactactggggtcaaggaacctcagtcaccgtctcctca

SEQ ID NO: 67 - protein, 121 aa, Mus musculus
QVQLQQSGTELVRPGTSVRVSCKASGYAFGNHLIEWVKQRPGQGLEWIGVINPGTGGTHYNEKFKDKARLTADKSSNTAYMHLNSLTSDDSAVYFCARSPYDYHEGAMDYWGQGTSVTVSS

SEQ ID NO: 68 - DNA, 339 bp, Mus musculus
  misc_feature (1)..(339): SC16.21 VL
  CDS (1)..(339)
gacattgtgatgacacagtctccatcctccctggctatgtcagtaggacagaaggtcactatgagctgcaagtccagtcagagccttttaaatagtagcaatcaaaagaattatttggcctggtatcagcaggaaccaggacagtctcctaaacttctggtatcctttgcatccactagggaatctggggtccctgatcgcttcacaggcagtggatctgggacagatttcactcttaccatcagcggtgtgcaggctgaagacctggcagtttattactgtcagcaacattatagcattccgctcacgttcggtgctgggaccaagctggagctgaaa

SEQ ID NO: 69 - protein, 113 aa, Mus musculus
DIVMTQSPSSLAMSVGQKVTMSCKSSQSLLNSSNQKNYLAWYQQEPGQSPKLLVSFASTRESGVPDRFTGSGSGTDFTLTISGVQAEDLAVYYCQQHYSIPLTFGAGTKLELK

SEQ ID NO: 70 - DNA, 372 bp, Mus musculus
  misc_feature (1)..(372): SC16.21 VH
  CDS (1)..(372)
caggttcagctacaacagtctggacctgagctggtgaagcctggggcctcagtgaagatttcctgcaaggcttctggctatgcattcagtagctcctggatgaactgggtgaagcagaggcctggaaagggtcttgagtggattggacggatttatcctggagatggagatactaactacaatgggaagttcaagggcaaggccacactgactgcagacaaatcctccagcacagcctacatgcaactcagcagcctgacatctgaggactctgcggtctacttctgtgcaatgggtatttataactacgatggtagccgttactattctatggactactggggtcaaggaacctcagtcaccgtctcctca

SEQ ID NO: 71 - protein, 124 aa, Mus musculus
QVQLQQSGPELVKPGASVKISCKASGYAFSSSWMNWVKQRPGKGLEWIGRIYPGDGDTNYNGKFKGKATLTADKSSSTAYMQLSSLTSEDSAVYFCAMGIYNYDGSRYYSMDYWGQGTSVTVSS

SEQ ID NO: 72 - DNA, 321 bp, Mus musculus
  misc_feature (1)..(321): SC16.22 VL
  CDS (1)..(321)
gatatccagatgacacagactacatcctccctgtctgcctctctgggagacagagtcaccatcagttgcagggcaagtcaggacattaagaattatttaaactggtatcagcagaaaccagatggaactgttaaacccctgatctactacacatcaagagtacactcaggagtcccatcaaggttcagtggcagtgggtctggaacagattattctctcaccattagcaacctggagcaagaagatattgccacttacttttgccagcagggttatacgcttccattcacgttcggctcggggacaaagttggaaathaar

SEQ ID NO: 73 - protein, 107 aa, Mus musculus
DIQMTQTTSSLSASLGDRVTISCRASQDIKNYLNWYQQKPDGTVKPLIYYTSRVHSGVPSRFSGSGSGTDYSLTISNLEQEDIATYFCQQGYTLPFTFGSGTKLEIK

SEQ ID NO: 74 - DNA, 360 bp, Mus musculus
  misc_feature (1)..(360): SC16.22 VH
  CDS (1)..(360)
caggtccagctgcagcagcctggggctgaactggtgaagcctggggcttcagtgaagctgtcctgtaaggcttctggatacaccttcactacctactggatgcactgggtgaagcagaggcctggacaaggccttgagtggatcggagagattgatccttctgatagttatacttactacaatcaaaagttcaagggcaaggccacattgactgtagacaaatcctccagcacagcctacatgcaactcagcagcctgacatctgaggactctgcggtctattattgtgcaagaggggactatggtaacccctatgctatggactactggggtcaaggatcctcagtcaccgtctcctca

SEQ ID NO: 75 - protein, 120 aa, Mus musculus
QVQLQQPGAELVKPGASVKLSCKASGYTFTTYWMHWVKQRPGQGLEWIGEIDPSDSYTYYNQKFKGKATLTVDKSSSTAYMQLSSLTSEDSAVYYCARGDYGNPYAMDYWGQGSSVTVSS

SEQ ID NO: 76 - DNA, 324 bp, Mus musculus
  misc_feature (1)..(324): SC16.23 VL
  CDS (1)..(324)
caaattgttctcacccagtctccagcaatcatgtctgcatctcctggggagaaggtcaccttgacctgcagtgccagctcaagtgtaagttccaggtacttgtactggtaccagcagaagccaggatcctcccccaaactctggatttatagcacatccaacctggcttctggagtccctgctcgcttcagtggcagtgggtctgggacctcttactctctcataatcagcagcatggaggctgaagatgctgcctcttatttctgccatcagtggagtaattacccactcacgttcggtgctgggaccaagctggagctgaaa

SEQ ID NO: 77 - protein, 108 aa, Mus musculus
QIVLTQSPAIMSASPGEKVTLTCSASSSVSSRYLYWYQQKPGSSPKLWIYSTSNLASGVPARFSGSGSGTSYSLIISSMEAEDAASYFCHQWSNYPLTFGAGTKLELK

SEQ ID NO: 78 - DNA, 372 bp, Mus musculus
  misc_feature (1)..(372): SC16.23 VH
  CDS (1)..(372)
caggttactctgaaagagtctggccctgggatattgcagccctcccagaccctcagtctgacttgttctttctctgggttttcactgagcacttctaatacgggcataggctggattcgtcagccttcagggacgggtctggagtggctggcacacatttggtggaatgatgataagtactataatccatccctgaagagccggctcacaatctccaaggaaacctccaacaaccaggtattcctcaagatcaccaatgtggacactgcagatactgcctcatacttctgtgttcaaatcgggcgcgactacagtaactacgcctggtatttcgatgtctggggcgcagggaccacggtcaccgtctcctca

SEQ ID NO: 79 - protein, 124 aa, Mus musculus
QVTLKESGPGILQPSQTLSLTCSFSGFSLSTSNTGIGWIRQPSGTGLEWLAHIWWNDDKYYNPSLKSRLTISKETSNNQVFLKITNVDTADTASYFCVQIGRDYSNYAWYFDVWGAGTTVTVSS

SEQ ID NO: 80 - DNA, 318 bp, Mus musculus
  misc_feature (1)..(318): SC16.25 VL
  CDS (1)..(318)
caaattgttctcacccagtctccagcaatcatgtctgcatctccaggggagaaggtcaccatgacctgcagtgccagctcaagtgtaagttacatgcactggtaccagcagaagtcaggcacctcccccaaaagatggatttatgactcatccaaactggcttctggagtccctgctcgcttcagtggcagtgggtctgggacctcttactctctcacaatcagcagcatggaggctgaagatgctgccacttattactgccagcagtggagtagtaacccgctcacgttcggtgctgggaccaagctggagctgaaa

SEQ ID NO: 81 - protein, 106 aa, Mus musculus
QIVLTQSPAIMSASPGEKVTMTCSASSSVSYMHWYQQKSGTSPKRWIYDSSKLASGVPARFSGSGSGTSYSLTISSMEAEDAATYYCQQWSSNPLTFGAGTKLELK

SEQ ID NO: 82 - DNA, 372 bp, Mus musculus
  misc_feature (1)..(372): SC16.25 VH
  CDS (1)..(372)
caggttactctgaaagagtctggccctgggatattgcagccctcccagaccctcagtctgacttgttctttctctgggttttcactgagcacttctggtatgggtgtaggctggattcgtcagccttcaggagagggtctagagtggctgacagacatttggtgggatgacaataagtactataacccatccctgaagagccggctcacaatctccaaggatacctccagcaaccaggtattcctcaatatcaccagtgtggacactgcagatactgccacttactactgtgctcgaagagttaactattattacgacccgtactatgctatggactactggggtcaaggaacctcagtcaccgtctcctca

SEQ ID NO: 83 - protein, 124 aa, Mus musculus
QVTLKESGPGILQPSQTLSLTCSFSGFSLSTSGMGVGWIRQPSGEGLEWLTDIWWDDNKYYNPSLKSRLTISKDTSSNQVFLNITSVDTADTATYYCARRVNYYYDPYYAMDYWGQGTSVTVSS

SEQ ID NO: 84 - DNA, 336 bp, Mus musculus; identical to SEQ ID NO: 44
  misc_feature (1)..(336): SC16.26 VL
  CDS (1)..(336)

SEQ ID NO: 85 - protein, 112 aa, Mus musculus; identical to SEQ ID NO: 45

SEQ ID NO: 86 - DNA, 351 bp, Mus musculus
  misc_feature (1)..(351): SC16.26 VH
  CDS (1)..(351)
cagatccagttggtgcagtctggacctgagctgaagaagcctggagagacagtcaagatctcctgcaaggcttctggttattccttcacagactattcaatgcactgggtgaagcaggctccaggaaagggtttaaagtggatgggctggataaacactgagactgttgagccaacatatgcagatgacttcatgggacggtttgccttctctttggaaacctctgccagcactgcctttttgcagatcaacaacctcgaaaatgaggacacggctacatatttctgtgctagatttggttcctatgctatggactactggggtcaaggaacctcagtnacvgtntcntcn

SEQ ID NO: 87 - protein, 117 aa, Mus musculus
  misc_feature (114)..(114): The 'Xaa' at location 114 stands for Thr.
  misc_feature (116)..(116): The 'Xaa' at location 116 stands for Ser.
  misc_feature (117)..(117): The 'Xaa' at location 117 stands for Ser.
QIQLVQSGPELKKPGETVKISCKASGYSFTDYSMHWVKQAPGKGLKWMGWINTETVEPTYADDFMGRFAFSLETSASTAFLQINNLENEDTATYFCARFGSYAMDYWGQGTSVXVXX

SEQ ID NO: 88 - DNA, 318 bp, Mus musculus
  misc_feature (1)..(318): SC16.29 VL
  CDS (1)..(318)
caaattgttctcacccagtctccagcaatcatgtctgcatctccaggggagaaggtcaccataacctgcagtgccagctcaagtgtaagttacatgcactggttccagcagaagccaggcacttctcccaaactctggatttataccacatccaacctggcttctggagtccctgctcgcttcagtggcagtggatctgggacctcttactctctcacagtcagccgaatggaggctgaagatgctgccacttattactgccagcaaaggagtctttatccgtacacgttcggaggggggaccaaggtggaaataaaa

SEQ ID NO: 89 - protein, 106 aa, Mus musculus
QIVLTQSPAIMSASPGEKVTITCSASSSVSYMHWFQQKPGTSPKLWIYTTSNLASGVPARFSGSGSGTSYSLTVSRMEAEDAATYYCQQRSLYPYTFGGGTKVEIK

SEQ ID NO: 90 - DNA, 363 bp, Mus musculus
  misc_feature (1)..(363): SC16.29 VH
  CDS (1)..(363)
caggttcagctacagcagtctggagctgagctggcgaggcccggggcttcagtgaagctgtcctgcaaggcttcaggctacaccttcactgaccagtatataaactgggtgaagcagaggactggacagggccttgagtggattggagagatttatcccggaaggggtaatacttactacaatgagaagttcaagggcaaggccacactgactgcagacaaatcctccagcacagcctacatgcaactcagcagcctgacatctgaggactctgcagtctatttctgtgcaagagaggatggtggttacgacgatgcctggtttgcttactggggccaagggactctggtcactgtctctgca

SEQ ID NO: 91 - protein, 121 aa, Mus musculus
QVQLQQSGAELARPGASVKLSCKASGYTFTDQYINWVKQRTGQGLEWIGEIYPGRGNTYYNEKFKGKATLTADKSSSTAYMQLSSLTSEDSAVYFCAREDGGYDDAWFAYWGQGTLVTVSA

SEQ ID NO: 92 - DNA, 324 bp, Mus musculus
  misc_feature (1)..(324): SC16.30 VL
  CDS (1)..(324)
caaattgttctgacccagtctccaacaatcatgtctgcatctctaggggaacgggtcaccatgacctgcactgccagctcaagtgtaacttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtttcatcgttccccattcacgttcggctcggggacaaagttggaaataaaa

SEQ ID NO: 93 - protein, 108 aa, Mus musculus
QIVLTQSPTIMSASLGERVTMTCTASSSVTSSYLHWYQQKPGSSPKLWIYSTSNLASGVPARFSGSGSGTSYSLTISSMEAEDAATYYCHQFHRSPFTFGSGTKLEIK

SEQ ID NO: 94 - DNA, 360 bp, Mus musculus
  misc_feature (1)..(360): SC16.30 VH
  CDS (1)..(360)
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataaaccagccctgaagagccgactgactgtctccaaggatacctccagcaaccaggttttcctcaagatcgccactgtggacgctgcagatactggcacatactactgtgctcgaatcgttgatggtcaccccccgtttgcttactggggccaagggactctggtcactgtctctgca

SEQ ID NO: 95 - protein, 120 aa, Mus musculus
QVTLKESGPGILQPSQTLSLTCSFSGFSLSTSGMGVGWIRQPSGKGLEWLAHIWWDDVKRYKPALKSRLTVSKDTSSNQVFLKIATVDAADTGTYYCARIVDGHPPFAYWGQGTLVTVSA

SEQ ID NO: 96 - DNA, 336 bp, Mus musculus
  misc_feature (1)..(336): SC16.30 VL
  CDS (1)..(336)
gacattgtgctgacccagtctccactctctctgcctgtcaatattggagatcaagcctctatctcttgcaagtctactaagagtcttctgaatagtgatggattcacttatttggactggtatttgcagaggccaggccagtctccacaattcctaatatatttggtttctaatcgattttctggagttccagacaggttcagtggcagtgggtcaggaacagatttcacactcaagatcagcagagtggaggctgaggatttgggagtatattattgcttccagagtaactatcttccgctcacgttcggtgctgggaccaagctggagctgaga

SEQ ID NO: 97 - protein, 112 aa, Mus musculus
DIVLTQSPLSLPVNIGDQASISCKSTKSLLNSDGFTYLDWYLQRPGQSPQFLIYLVSNRFSGVPDRFSGSGSGTDFTLKISRVEAEDLGVYYCFQSNYLPLTFGAGTKLELR

SEQ ID NO: 98 - DNA, 357 bp, Mus musculus
  misc_feature (1)..(357): SC16.31 VH
  CDS (1)..(357)
gaggtccaactgcagcagtctggacctgagctggtgaagcctggggcttcagtgaagatatcctgcaaggcttctggttactcattcagtcgtttctatatgcactgggtgaagcaaagtcctgaaaatagtcttgagtggattggagagattaatcctagcactgggggtacaagctacaaccagaagttcaagggcaaggccacattaactgtagataaatcctccagcacagcctacatgcagctcaagagcctgacatctgaagagtctgcagtctattactgtactaggggttacgggagcaactggtacttcgatgtctggggcgcagggaccacggtcaccgtctccaca

SEQ ID NO: 99 - protein, 119 aa, Mus musculus
EVQLQQSGPELVKPGASVKISCKASGYSFSRFYMHWVKQSPENSLEWIGEINPSTGGTSYNQKFKGKATLTVDKSSSTAYMQLKSLTSEESAVYYCTRGYGSNWYFDVWGAGTTVTVST

SEQ ID NO: 100 - DNA, 321 bp, Mus musculus
  misc_feature (1)..(321): SC16.34 VL
  CDS (1)..(321)
agtattgtgatgacccagactcccaaattcctgcttgtatcagcaggagacagggttaccataacctgcaaggccagtcagagtgtgagtaatgatgtagcttggtaccaacagaagccagggcagtctcctaaactgctgatatactatgcatccaatcgctacagtggagtccctgatcgcttcactggcagtggatatgggacggatttcactttcaccatcagcactgtgcaggctgaagacctggcagtttatttctgtcagcaggattatagctctccgtggacgttcggtggaggcaccaagctggaaatcaaa

SEQ ID NO: 101 - protein, 107 aa, Mus musculus
SIVMTQTPKFLLVSAGDRVTITCKASQSVSNDVAWYQQKPGQSPKLLIYYASNRYSGVPDRFTGSGYGTDFTFTISTVQAEDLAVYFCQQDYSSPWTFGGGTKLEIK

SEQ ID NO: 102 - DNA, 354 bp, Mus musculus
  misc_feature (1)..(354): SC16.34 VH
  CDS (1)..(354)
cagatccagttggtgcagtctggacctgagctgaagaggcctggagagacagtcaagatctcctgcaaggcttctggatataccttcacaaactatggaatgaactgggtgaagcaggctccaggaaagggtttaaagtggatgggctggataaacacgtacactggagacccaacatatgctgatgacttcaagggacggtttgccttctctttggaaacctctgccagcactgcctatttgcagatcaacaacctcaaaaatgaggacacggctacatatttctgtgcaagaattggcggtaatagtccctctgattactggggccaaggcacctctctcacagtctcctca

SEQ ID NO: 103 - protein, 118 aa, Mus musculus
QIQLVQSGPELKRPGETVKISCKASGYTFTNYGMNWVKQAPGKGLKWMGWINTYTGDPTYADDFKGRFAFSLETSASTAYLQINNLKNEDTATYFCARIGGNSPSDYWGQGTSLTVSS

SEQ ID NO: 104 - DNA, 321 bp, Mus musculus
  misc_feature (1)..(321): SC16.35 VL
  CDS (1)..(321)
gatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggaaataaaa

SEQ ID NO: 105 - protein, 107 aa, Mus musculus
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIK

SEQ ID NO: 106 - DNA, 360 bp, Mus musculus
  misc_feature (1)..(360): SC16.35 VH
  CDS (1)..(360)
gatgtgcagcttcaggagtcgggacctggcctggtgaaaccttctcagtctctgtccctcacctgcactgtcactggctactcaatcaccagtgattatgcctggaactggatccggcagtttccaggaaacaaactggagtggatgggctacataagctacagtggtagcactagctacaacccatctctcaaaagtcgaatctctatcactcgagacacatccaagaaccagttcttcctgcagttgaattctgtgactactgaggacacagccacatattactgtgcaagattttactacggtagtagctatgctatggactactggggtcaaggaacctcagtcaccgtctcctca

SEQ ID NO: 107 - protein, 120 aa, Mus musculus
DVQLQESGPGLVKPSQSLSLTCTVTGYSITSDYAWNWIRQFPGNKLEWMGYISYSGSTSYNPSLKSRISITRDTSKNQFFLQLNSVTTEDTATYYCARFYYGSSYAMDYWGQGTSVTVSS

SEQ ID NO: 108 - DNA, 321 bp, Mus musculus
  misc_feature (1)..(321): SC16.36 VL
  CDS (1)..(321)
gaaacaactgtgacccagtctccagcatccctgtccgtgactacaggagaaaaagtcactatcagatgcataaccacccctgatattgatgatgatatgaactggtaccagcagaagccaggggaacctcctaacctccttatttcagaaggcaatagtcttcgtcctggagtcccatcccgattctccagcagtggctatggcacaaattttgtttttacaattgaaaacacgctctcagaagatgttgcagattactactgtttgcaaagtgataacatgccattcacgttcggctcggggacaaagttggaaataaar

SEQ ID NO: 109 - protein, 107 aa, Mus musculus
ETTVTQSPASLSVTTGEKVTIRCITTPDIDDDMNWYQQKPGEPPNLLISEGNSLRPGVPSRFSSSGYGTNFVFTIENTLSEDVADYYCLQSDNMPFTFGSGTKLEIK

SEQ ID NO: 110 - DNA, 354 bp, Mus musculus
  misc_feature (1)..(354): SC16.35 VH
  CDS (1)..(354)
caggtccagctgcagcagtctggggctgaactggcaaaacctggggcctcagtgaagatgtcctgcaaggcttctggctacacctttactacctactggatgcactgggtaaaacagaggcctggacagggtctggaatggattggatacattaatcctagcagtggttatactgagtacaatcagaagttcaaggacaaggccacattgactgcagacaaatcctccagcacagcctacatgcaactaagcagcctgacatctgaggactcttcagtctattactgtgcaagaaagggtagtaacagggggtttgcttactggggccaagggactctggtcactgtctcttcn

SEQ ID NO: 111 - protein, 118 aa, Mus musculus
  misc_feature (118)..(118): The 'Xaa' at location 118 stands for Ser.
QVQLQQSGAELAKPGASVKMSCKASGYTFTTYWMHWVKQRPGQGLEWIGYINPSSGYTEYNQKFKDKATLTADKSSSTAYMQLSSLTSEDSSVYYCARKGSNRGFAYWGQGTLVTVSX

SEQ ID NO: 112 - DNA, 312 bp, Mus musculus
  misc_feature (1)..(312): SC16.38 VL
  CDS (1)..(312)
caaattgttctcacccagtctccagcaatcatgtctgcatctccaggggagaaggtcaccatgacctgcagtgccagctcaagtataaattacatgcactggtaccagcagaagccaggcacctcccccaaaagatggatttatgacacatccaaactggcttctggagtccctgctcgcttcagtggcagtgggtctgggacctcttattctctcacaatcagcagcatggaggctgaagatgctgccacttattactgccatcagcggagtacgtggacgttcggtggaggcaccaagctggaaatcaaa

SEQ ID NO: 113 - protein, 104 aa, Mus musculus
QIVLTQSPAIMSASPGEKVTMTCSASSSINYMHWYQQKPGTSPKRWIYDTSKLASGVPARFSGSGSGTSYSLTISSMEAEDAATYYCHQRSTWTFGGGTKLEIK

SEQ ID NO: 114 - DNA, 348 bp, Mus musculus
  misc_feature (1)..(348): SC16.38 VH
  CDS (1)..(348)
gaggttcagctgcagcagtctggggcagagcttgtgaagccaggggcctcagtcaagttgtcctgcacagtttctggcttcaacattaaagacacctatatacactgggtgaagcagaggcctgaacagggcctggagtggattggaaggattgatcctgcgaatggtaatactaaatatgacccgaagttccagggcaaggccactataacagcagacacatcctccaacacagcctacctgcagctcagcagcctgacatctgaggacactgccgtctattactgtgctagaccgacggggtactttgaatactggggccaaggcaccactctcacagtctcctca

SEQ ID NO: 115 - protein, 116 aa, Mus musculus
EVQLQQSGAELVKPGASVKLSCTVSGFNIKDTYIHWVKQRPEQGLEWIGRIDPANGNTKYDPKFQGKATITADTSSNTAYLQLSSLTSEDTAVYYCARPTGYFEYWGQGTTLTVSS

SEQ ID NO: 116 - DNA, 321 bp, Mus musculus
  misc_feature (1)..(321): SC16.41 VL
  CDS (1)..(321)
gatatccagatgacacagactacatcctccctgtctgcctctttgggagacagagtcaccatcagttgcagggcaagtcaggatgttatcaattatttaaactggtatcagcagaaaccagatggaactgttaaactcctgatctactacacatcaaggttacactcaggagtcccatcaaggttcagtggcagtgggtctaggacagattattctctcaccatcagcaacctggaacctgaagatattgccacttactattgtcagcagtatagtgagcgtccgtacacgttcggaggggggaccaagctggaaataaaa

SEQ ID NO: 117 - protein, 107 aa, Mus musculus
DIQMTQTTSSLSASLGDRVTISCRASQDVINYLNWYQQKPDGTVKLLIYYTSRLHSGVPSRFSGSGSRTDYSLTISNLEPEDIATYYCQQYSERPYTFGGGTKLEIK

SEQ ID NO: 118 - DNA, 351 bp, Mus musculus
  misc_feature (1)..(351): SC16.41 VH
  CDS (1)..(351)
gaagtgaagcttgaggagtctggaggaggcttggtgcaatttggaggatccatgaaactctcttgtgctgcttctggattcacttttagtgatgcctggatggactgggtccgccagtctccagagaaggggcttgagtgggttgctgaaattagaaacaaagctaataatcatgcaacatattatcctgagtctgtgaaagggaggttcaccatctcaagagatgattccaaaagtagagtgtacctgcaaatgaacaacttaagagctgaagacactggcatttattactgtacgggttactcctcgtttgcttactggggccaagggactctggtcactgtctctgca

SEQ ID NO: 119 - protein, 117 aa, Mus musculus
EVKLEESGGGLVQFGGSMKLSCAASGFTFSDAWMDWVRQSPEKGLEWVAEIRNKANNHATYYPESVKGRFTISRDDSKSRVYLQMNNLRAEDTGIYYCTGYSSFAYWGQGTLVTVSA

SEQ ID NO: 120 - DNA, 336 bp, Mus musculus
  misc_feature (1)..(336): SC16.42 VL
  CDS (1)..(336)
gatgttttgatgacacagtctccactctccctgtctgtcagtcttggagatcaagcctccatctcttgtagatctagtcagaacattgtacacagtgatagatacacctatttagaatggtacctgcagaaaccaggccagtcgccaaaactcctgatatatggggtttccaaccgattttctggggtcccagacaggttcagtggcagtggatcagggacagatttcacactcaagatcagcagagtggaggctgaggatatgggagtttattactgctttcaaggtacacatgttccgtacacgttcggaggggggaccaagctggaaataaaa

SEQ ID NO: 121 - protein, 112 aa, Mus musculus
DVLMTQSPLSLSVSLGDQASISCRSSQNIVHSDRYTYLEWYLQKPGQSPKLLIYGVSNRFSGVPDRFSGSGSGTDFTLKISRVEAEDMGVYYCFQGTHVPYTFGGGTKLEIK

SEQ ID NO: 122 - DNA, 354 bp, Mus musculus
  misc_feature (1)..(354): SC16.42 VH
  CDS (1)..(354)
cagatccagttggtgcagtctggacctgaactgaagaagcctggagagacagtcaagatctcctgcaaggcttctgggtataccttcacaactgctggaatgcagtgggtgcaaaagatgccaggaaagggttttaagtggattggctggataaacacccactctggagagccaaaatatgcagatgacttcaagggacggtttgccttctctttggaaacctctgccagcactgcctatttacagataagcaacctcaaagacgaggacacggctacgtttttctgtgcgcccctatggtccgatagtagttttgcttactggggccaaggaactctggtcactgtctctgca

SEQ ID NO: 123 - protein, 118 aa, Mus musculus
QIQLVQSGPELKKPGETVKISCKASGYTFTTAGMQWVQKMPGKGFKWIGWINTHSGEPKYADDFKGRFAFSLETSASTAYLQISNLKDEDTATFFCAPLWSDSSFAYWGQGTLVTVSA

SEQ ID NO: 124 - DNA, 321 bp, Mus musculus
  misc_feature (1)..(321): SC16.45 VL
  CDS (1)..(321)
gaaatccagatgacccagtctccatcctctatgtctgcatctctgggagacagaataaccatcacttgccaggcaactcaagacattgttaagaatttaaactggtatcagcagaaaccagggaaacccccttcattcctgatctattatgcaactgaactggcagaaggggtcccagcaaggttcagtggcagtgggtctgggtcagactattctctgacaatcagcaacctggagtctgaagattttgcagactatcactgtctacagttttatgagtttccgttcacgttcggtgctgggaccaagctggagctgaaa

SEQ ID NO: 125 - protein, 107 aa, Mus musculus
EIQMTQSPSSMSASLGDRITITCQATQDIVKNLNWYQQKPGKPPSFLIYYATELAEGVPARFSGSGSGSDYSLTISNLESEDFADYHCLQFYEFPFTFGAGTKLELK

SEQ ID NO: 126 - DNA, 363 bp, Mus musculus
  misc_feature (1)..(363): SC16.45 VH
  CDS (1)..(363)
caggtccagctgcagcagtctggagctgacctggtaaggcctgggacttcagtgaaggtgtcctgcaaggcttctggatactccttcactaattacctgatagagtgggtaaagcagaggccaggacagggccttgagtggattggagtgattaatcctggaagtggtggaactcactacaatgagaaattcaaggacaaggcagttctgactgcagacaaatcctccactactgcccacatgcagctcagcagcctgacatctgatgactctgcggtctatttctgtgcaagatccccctatgattataacgatggtgctatggactactggggtcaaggaacctcagtcaccgtctcttca

SEQ ID NO: 127 - protein, 121 aa, Mus musculus
QVQLQQSGADLVRPGTSVKVSCKASGYSFTNYLIEWVKQRPGQGLEWIGVINPGSGGTHYNEKFKDKAVLTADKSSTTAHMQLSSLTSDDSAVYFCARSPYDYNDGAMDYWGQGTSVTVSS

SEQ ID NO: 128 - DNA, 336 bp, Mus musculus
  misc_feature (1)..(336): SC16.47 VL
  CDS (1)..(336)
gatgttgttctgacccagtctccactctctctgcctgtcaatattggagatcaagcctctatctcttgcaagtctactaagagtcttctgaatagtgatggattcacttatttggactggtatttgcagaggccaggccagtctccacaattcctaatatatttggtttctaatcgattttctggagttccagacaggttcagtggcagtgggtcaggaacagatttcacactcaagatcagcagagtggaggctgaggatttgggagtatattattgcttccagagtaactatcttccgctcacgttcggtgctgggaccaagctggagctgaga

SEQ ID NO: 129 - protein, 112 aa, Mus musculus
DVVLTQSPLSLPVNIGDQASISCKSTKSLLNSDGFTYLDWYLQRPGQSPQFLIYLVSNRFSGVPDRFSGSGSGTDFTLKISRVEAEDLGVYYCFQSNYLPLTFGAGTKLELR

SEQ ID NO: 130 - DNA, 357 bp, Mus musculus
  misc_feature (1)..(357): SC16.47 VH
  CDS (1)..(357)
gaggtccaactgcagcagtctggacctgagctggtgaagcctggggcttcagtgaagatatcctgcaaggcttctggttactcattcagtcgtttctatatgcactgggtgaagcaaagtcctgaaaatagtcttgagtggattggagagattaatcctagcactgggggtacaagctacaaccagaagttcaagggcaaggccacattaactgtagataaatcctccagcacagcctacatgcagctcaagagcctgacatctgaagagtctgcagtctattactgtactaggggttacgggagcaactgttacttcgatgtctggggcgcagggaccacggtcaccgtctccaca

SEQ ID NO: 131 - protein, 119 aa, Mus musculus
EVQLQQSGPELVKPGASVKISCKASGYSFSRFYMHWVKQSPENSLEWIGEINPSTGGTSYNQKFKGKATLTVDKSSSTAYMQLKSLTSEESAVYYCTRGYGSNCYFDVWGAGTTVTVST

SEQ ID NO: 132 - DNA, 321 bp, Mus musculus
  misc_feature (1)..(321): SC16.49 VL
  CDS (1)..(321)
gacatcaagatgacccagtctccatcttccatgtatgcatctctaggagagagagtcactatcacttgcaaggcgagtcaggacattaatagttatttaagctggttccagcagaaaccagggaaatctcctaagaccctgatctatcgagcaaacagattggtagatggggtcccatcaaggttcagtggcagtggatctgggcaagattattctctcaccatcaccagcctggagtatgaagatatgggaatttattattgtctacagtatgatgaatttccgctcacgttcggtgctgggaccaagctggagctgaaa

SEQ ID NO: 133 - protein, 107 aa, Mus musculus
DIKMTQSPSSMYASLGERVTITCKASQDINSYLSWFQQKPGKSPKTLIYRANRLVDGVPSRFSGSGSGQDYSLTITSLEYEDMGIYYCLQYDEFPLTFGAGTKLELK

SEQ ID NO: 134 - DNA, 351 bp, Mus musculus
  misc_feature (1)..(351): SC16.49 VH
  CDS (1)..(351)
caggttcaactgcagcagtctggacctgagctggtgaagcctgggactttagtgaagatatcctgcaaggcttctggttacaccttcacaagctacgatataaactgggtgaagcagaggcctggacagggacttgaatggattggatggatttatcctggagatggtaatactaagtacagtgagaaattcaagggcaaggccacactgactgcagacaaatcctccagcacagcctacatgcagctcaccagcctgacttctgagaactctgcagtctatttctgtgcaagagactatgattacccttttgcttactggggccaagggactctggtcactgtctctgca

SEQ ID NO: 135 - protein, 117 aa, Mus musculus
QVQLQQSGPELVKPGTLVKISCKASGYTFTSYDINWVKQRPGQGLEWIGWIYPGDGNTKYSEKFKGKATLTADKSSSTAYMQLTSLTSENSAVYFCARDYDYPFAYWGQGTLVTVSA

SEQ ID NO: 136 - DNA, 318 bp, Mus musculus
  misc_feature (1)..(318): SC16.50 VL
  CDS (1)..(318)
gatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggtacagattattctctcaccattagcaacctggagcaagaagatattgccacttacttttgccaacagggtaatacgcttcggacgttcggtggaggcaccaagctggaaatcaaa

SEQ ID NO: 137 - protein, 106 aa, Mus musculus
DIQMTQTTSSLSASLGDRVTISCRASQDISNYLNWYQQKPDGTVKLLIYYTSRLHSGVPSRFSGSGSGTDYSLTISNLEQEDIATYFCQQGNTLRTFGGGTKLEIK

SEQ ID NO: 138 - DNA, 363 bp, Mus musculus
  misc_feature (1)..(363): SC16.50 VH
  CDS (1)..(363)
gaagtgcagctggtggagtgtgggggatgcttagtgaagcctggagggtacctgaaactctcctgtgcagcctctggattcactttcagtagctatgccatgtcttgggttcgccagtctccagagaagaggctggagtgggtcgcagaaatcagtattggtggtagctacacctactatccagacactgtgacgggccgattcaccatctccagagacaatgccaagaacaccctgtacctggaaatgagcagtctgaggtctgaggacacggccatgtattactgtgcaagggagggctatgattacgacgtgagagctatggactactggggtcaaggaacctcagtcaccgtctcctca

SEQ ID NO: 139 - protein, 121 aa, Mus musculus
EVQLVECGGCLVKPGGYLKLSCAASGFTFSSYAMSWVRQSPEKRLEWVAEISIGGSYTYYPDTVTGRFTISRDNAKNTLYLEMSSLRSEDTAMYYCAREGYDYDVRAMDYWGQGTSVTVSS

SEQ ID NO: 140 - DNA, 321 bp, Mus musculus
  misc_feature (1)..(321): SC16.52 VL
  CDS (1)..(321)
gacatccagatgattcagtctccatcgtccatgtttgcctctctgggagacagagtcagtctctcttgtcgggctagtcagggcattagagggactttagactggtatcaacagaaaccaaatggaactattaaactcctgatctactccacatccaatttaaattctggtgtcccatcaaggttcagtggcagtgggtctgggtcagattattctctcaccatcagcagcctagagtctgaagattttgcagactattactgtctacagcgtaatgcgtatcctctcacgttcggtgctgggaccaagctggagctgaaa

SEQ ID NO: 141 - protein, 107 aa, Mus musculus
DIQMIQSPSSMFASLGDRVSLSCRASQGIRGTLDWYQQKPNGTIKLLIYSTSNLNSGVPSRFSGSGSGSDYSLTISSLESEDFADYYCLQRNAYPLTFGAGTKLELK

SEQ ID NO: 142 - DNA, 357 bp, Mus musculus
  misc_feature (1)..(357): SC16.52 VH
  CDS (1)..(357)
caggtgcagctgaaggagtcaggacctggcctggtggcgccctcacagagcctgtccatcacgtgcgctgtctctggattttcattaaccagctttgcaatacactggtttcgcaagcctccaggaaagggtctggagtggctgggagtaatatggactggtggaaccacaaattataattcggctctcatgtccagactgagcatcagcaaagacaactccaagagccaagttttcttaaaaatgaacagtctgcaaactgatgacacagccatgtactactgtgccagagacgattacgacaataattatgctatggactactggggtcaaggaacctcagtcaccgtctcctca

SEQ ID NO: 143 - protein, 119 aa, Mus musculus
QVQLKESGPGLVAPSQSLSITCAVSGFSLTSFAIHWFRKPPGKGLEWLGVIWTGGTTNYNSALMSRLSISKDNSKSQVFLKMNSLQTDDTAMYYCARDDYDNNYAMDYWGQGTSVTVSS

SEQ ID NO: 144 - DNA, 321 bp, Mus musculus
  misc_feature (1)..(321): SC16.55 VL
  CDS (1)..(321)
gacatcaagatgacccagtctccatcttccatgtatgcatctctaggagagagagtcactatcacttgcaaggcgagtcaggacattaatagctatttaaactggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccgtacacgttcggaggggggaccaagctggaaataaaa

SEQ ID NO: 145 - protein, 107 aa, Mus musculus
DIKMTQSPSSMYASLGERVTITCKASQDINSYLNWFQQKPGKSPKTLIYRANRLVDGVPSRFSGSGSGQDYSLTISSLEYEDMGIYYCLQYDEFPYTFGGGTKLEIK

SEQ ID NO: 146 - DNA, 351 bp, Mus musculus
  misc_feature (1)..(351): SC16.55 VH
  CDS (1)..(351)
gaggtgcagcttgttgagtctggtggaggattggtgcagcctaaagggtcattgaaactctcatgtgcagtctctgcattcaccttcactacctacgccatgaactgggtccgccaggctccaggaaagggtttggagtgggttgctcgcataagaaataaaagtaataattatgcaacatattatgccgattcagtgaaagacaggttcaccatctccagagatgattcacaaagcatgctctatctgcaaatgaacaacttgaaaattgaggacacagccatgtattactgtgtgttctactatgattacgtctactggggccaagggactctggtcactgtctctgca

SEQ ID NO: 147 - protein, 117 aa, Mus musculus
EVQLVESGGGLVQPKGSLKLSCAVSAFTFTTYAMNWVRQAPGKGLEWVARIRNKSNNYATYYADSVKDRFTISRDDSQSMLYLQMNNLKIEDTAMYYCVFYYDYVYWGQGTLVTVSA

SEQ ID NO: 148 - DNA, 321 bp, Mus musculus
  misc_feature (1)..(321): SC16.56 VL
  CDS (1)..(321)
agtattgtgatgacccagactcccaaattcctgcttgtatcagcaggagacagggttaccataacctgcaaggccagtcagagtgtgagtaatgatgtagtatggtaccaacagaagccagggcagtctcctaaactgctgatatactatgcatccaatcgctacactggagtccctgatcgcttcgctggcagtggatatgggacggatttctctttcaccatcagcactgtgcaggctgaagacctggcagtttatttctgtcagcaggattatacctctccgtggacgttcggtggaggcaccaagctggaaatcaga

SEQ ID NO: 149 - protein, 107 aa, Mus musculus
SIVMTQTPKFLLVSAGDRVTITCKASQSVSNDVVWYQQKPGQSPKLLIYYASNRYTGVPDRFAGSGYGTDFSFTISTVQAEDLAVYFCQQDYTSPWTFGGGTKLEIR

SEQ ID NO: 150 - DNA, 354 bp, Mus musculus
  misc_feature (1)..(354): SC16.56 VH
  CDS (1)..(354)
cagatccagttggtgcagtctggacctgaactgaagaagcctggagagacagtcaagatctcctgcaaggcttctgggtataccttcacaaactatggaatgaactgggtgaagcaggctccaggaaagggtttaaagtggatggcctggataaacacctacactggagagccaacatatgctgatgacttcaagggacggtttgccttctctttggaaacctctgccagcactgcctctttgcagatcatcaacctcaaaaatgaggacacggctacatatttctgtgcaaggatcggcgatagtagtccctctgactactgggggcagggcaccactctcacagtctcctca

SEQ ID NO: 151 - protein, 118 aa, Mus musculus
QIQLVQSGPELKKPGETVKISCKASGYTFTNYGMNWVKQAPGKGLKWMAWINTYTGEPTYADDFKGRFAFSLETSASTASLQIINLKNEDTATYFCARIGDSSPSDYWGQGTTLTVSS

SEQ ID NO: 152 - DNA, 321 bp, Mus musculus
  misc_feature (1)..(321): SC16.57 VL
  CDS (1)..(321)
gacattgtgatgacccagtctcacaaattcatgtccatatcagtaggagacagggtcagcatcacctgcaaggccagtcaggatgtgagtatttttgtagcctggtatcaacagaaaccaggacaatctcctaaactactgatttactcggcatcctaccggtacactggagtccctgatcgcttcactggcagtggatctgggacggatttcattttcaccatcagcagtgtgcaggctgaagacctggcagtttactactgtcagcaacattatggtactccattcacgttcggctcggggacaaagttgaaaataaga

SEQ ID NO: 153 - protein, 107 aa, Mus musculus
DIVMTQSHKFMSISVGDRVSITCKASQDVSIFVAWYQQKPGQSPKLLIYSASYRYTGVPDRFTGSGSGTDFIFTISSVQAEDLAVYYCQQHYGTPFTFGSGTKLKIR

SEQ ID NO: 154 - DNA, 354 bp, Mus musculus
  misc_feature (1)..(354): SC16.57 VH
  CDS (1)..(354)
gaagtgaaactggtggagtctgggggagacttagtgaagcctggagggtccctaaaactctcctgtgcagcctctggattcgctttcagtagttatgacatgtcttgggttcgccagactccggagaagagactggagtgggtcgcaaccattagcagtggtggtagttacacctattatccagacagtgtgaagggccgattcaccatctccagagacaatgtcagggacaccctgtacctgcaaatgagcagtttgaggtctgaggacacggccttgtattactgtgcaagacaggcaattgggacgtactttgactactggggccaaggcaccactctcacagtctcctca

SEQ ID NO: 155 - protein, 118 aa, Mus musculus
EVKLVESGGDLVKPGGSLKLSCAASGFAFSSYDMSWVRQTPEKRLEWVATISSGGSYTYYPDSVKGRFTISRDNVRDTLYLQMSSLRSEDTALYYCARQAIGTYFDYWGQGTTLTVSS

SEQ ID NO: 156 - DNA, 321 bp, Mus musculus
  misc_feature (1)..(321): SC16.58 VL
  CDS (1)..(321)
gacatccagatgactcagtctccagcctccctatcttcatctgtgggagaaactgtcaccatcacatgtcgagcaagtgagaatatttacagttatttagcatggtatcagcagaaacagggaaaatctcctcagctcctggtctataatgcaaaaactttagcagaaggtgtgccatcaaggttcagtggcagtggatcaggcacacagttttctctgaagatcaacagcctgcagcctgaagattttgggacttattactgtcaacatcattatgattctccgctcacgttcggtgctgggaccaagctggagctgaga

SEQ ID NO: 157 - protein, 107 aa, Mus musculus
DIQMTQSPASLSSSVGETVTITCRASENIYSYLAWYQQKQGKSPQLLVYNAKTLAEGVPSRFSGSGSGTQFSLKINSLQPEDFGTYYCQHHYDSPLTFGAGTKLELR

SEQ ID NO: 158 - DNA, 360 bp, Mus musculus
  misc_feature (1)..(360): SC16.58 VH
  CDS (1)..(360)
gatgtgcagctggtggagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaacatctactatgcagacacagtgaagggccgattcaccatctccagagacaatcccaagaacaccctgttcctgcaaatgaccagtctaaggtctgaggacacggccatgtattactgtgcaagaggctactatggtaactacgatgctatggactactggggtcaaggaacctcagtcaccgtctcctca

SEQ ID NO: 159 - protein, 120 aa, Mus musculus
DVQLVESGGGLVQPGGSRKLSCAASGFTFSSFGMHWVRQAPEKGLEWVAYISSGSSNIYYADTVKGRFTISRDNPKNTLFLQMTSLRSEDTAMYYCARGYYGNYDAMDYWGQGTSVTVSS

SEQ ID NO: 160 - DNA, 339 bp, Mus musculus
  misc_feature (1)..(339): SC16.61 VL
  CDS (1)..(339)
gatattgtgatgacacagtctacatcctccctggctatgtcagtaggacagaaggtcactatgagctgcaagtccagtcagagccttttaaatagtagcaatcaaaagaattatttggcctggtaccagcaggaaccaggacagtctcctaaacttctggtatcctttgcatccactagggaatctggggtccctgatcgcttcacaggcagtggatctgggacagatttcactcttaccatcagcggtgtgcaggctgaagacctggcagtttattactgtcagcaacattatagcattccgctcacgttcggtgctggaaccaagctggagctgaaa

SEQ ID NO: 161 - protein, 113 aa, Mus musculus
DIVMTQSTSSLAMSVGQKVTMSCKSSQSLLNSSNQKNYLAWYQQEPGQSPKLLVSFASTRESGVPDRFTGSGSGTDFTLTISGVQAEDLAVYYCQQHYSIPLTFGAGTKLELK

SEQ ID NO: 162 - DNA, 360 bp, Mus musculus
  misc_feature (1)..(360): SC16.61 VH
  CDS (1)..(360)
gaggtcctgctccaacggtctggacctgacctggtgaagcctggggcttcagtgacgataccctgcaaggcttctggatacacattcactgactacaacatggactgggtgaagcagagccatggaaagagccttgagtggattggaaatattaatacttacaatggtggtactatctacaaccagaagttcaagggcaaggccacattgactgtagacaagccctccagcacagcctacatggagctccgcagcctgacatctgaggacactgcagtctattactgtgcaagacgtctacggtatgggggacactactttgactactggggccaaggcaccgctctcacagtctcctca

SEQ ID NO: 163 - protein, 120 aa, Mus musculus
EVLLQRSGPDLVKPGASVTIPCKASGYTFTDYNMDWVKQSHGKSLEWIGNINTYNGGTIYNQKFKGKATLTVDKPSSTAYMELRSLTSEDTAVYYCARRLRYGGHYFDYWGQGTALTVSS

SEQ ID NO: 164 - DNA, 321 bp, Mus musculus
  misc_feature (1)..(321): SC16.62 VL
  CDS (1)..(321)
gacatcaagatgacccagtctccatcttccatgtatgcatctctaggagagagagtcactatcacttgcaaggcgagtcaggacattaatagctttttaagctggttccagcggaaaccagggaaatctccgaagaccctgatctatcgtgcaaacagattagtagatggagtcccatcaaggttcactggcagtggatctgggcaagaattttctctcaccatcagcagcctggagtatgaagatttgggaatttattattgtcttcagtatgatgagtttccgtacacgttcggaggggggaccaagctggaaataaaa

SEQ ID NO: 165 - protein, 107 aa, Mus musculus
DIKMTQSPSSMYASLGERVTITCKASQDINSFLSWFQRKPGKSPKTLIYRANRLVDGVPSRFTGSGSGQEFSLTISSLEYEDLGIYYCLQYDEFPYTFGGGTKLEIK

SEQ ID NO: 166 - DNA, 351 bp, Mus musculus
  misc_feature (1)..(351): SC16.62 VH
  CDS (1)..(351)
gaagtgatgctggtagagtctgggggagacttagtgaagcctggagggtccctgaaactctcctgtgcagcctctggattcactttcagtagctatgccatgtcttgggttcgccagactccggagaagaggctggagtgggtcgcatacattagcggtggtggtgatcacatctattatccagacagtgtgaggggccgattcaccatctccagagacaatgccaaggacaccctgtacctgcaaatgagcagtctgaggtctgaggacacggccttgtatgactgtgcaagagtgagagactggtacttcgatgtctggggcgcagggaccacggtcaccgtctcctca

SEQ ID NO: 167 - protein, 117 aa, Mus musculus
EVMLVESGGDLVKPGGSLKLSCAASGFTFSSYAMSWVRQTPEKRLEWVAYISGGGDHIYYPDSVRGRFTISRDNAKDTLYLQMSSLRSEDTALYDCARVRDWYFDVWGAGTTVTVSS

SEQ ID NO: 168 - DNA, 318 bp, Mus musculus
  misc_feature (1)..(318): SC16.63 VL
  CDS (1)..(318)
caaattgttctcacccagtctccagcaatcatgtctgcatctccaggggagaaggtcaccatgacctgcagtgccagctcaagtgtcagttacatgtactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggagtagtaacccgtacacgttcggaggggggaccaagctggaaataaar

SEQ ID NO: 169 - protein, 106 aa, Mus musculus
QIVLTQSPAIMSASPGEKVTMTCSASSSVSYMYWYQQKSGTSPKRWIYDTSKLASGVPARFSGSGSGTSYSLTISSMEAEDAATYYCQQWSSNPYTFGGGTKLEIK

SEQ ID NO: 170 - DNA, 342 bp, Mus musculus
  misc_feature (1)..(342): SC16.63 VH
  CDS (1)..(342)
caggttcagctgcagcagtctggaactgagctgctgaggcctggggcctcagtgaagatatcctgcaaggctactggctacacattcagtagctactggatggagtgggtaaagcagaggcctggacatggccttgagtggattggagagattttacctggaagtggtactactcagtacaatgagaagttcaagggcaaggccaccttcactgcagatacatcctccaacacagcctacatgcatctcagcagcctgacatctgaggactctgccgtctattactgtgcaagagggactaactctctctggggccaagggactctggtcactgtctctgca

SEQ ID NO: 171 - protein, 114 aa, Mus musculus
QVQLQQSGTELLRPGASVKISCKATGYTFSSYWMEWVKQRPGHGLEWIGEILPGSGTTQYNEKFKGKATFTADTSSNTAYMHLSSLTSEDSAVYYCARGTNSLWGQGTLVTVSA

SEQ ID NO: 172 - DNA, 318 bp, Mus musculus
  misc_feature (1)..(318): SC16.65 VL
  CDS (1)..(318)
caaattgttctcacccagtctccagcactcatgtctgcatctccaggggagaaggtcaccatgacctgcagtgtcacctcaagtgtaagttacatgtactggtaccagcagaagcctagatcctcccccaaaccctggatttatctcacatccaacctggcttctggagtccctgctcgcttcagtggcagtgggtctgggacctcttactctctcacaatcagcagcgtggaggctgaagatgctgccacttattactgccagcagtggaggaataacccattcacgttcggctcggggacaaaggtggaaataaaa

SEQ ID NO: 173 - protein, 106 aa, Mus musculus
QIVLTQSPALMSASPGEKVTMTCSVTSSVSYMYWYQQKPRSSPKPWIYLTSNLASGVPARFSGSGSGTSYSLTISSVEAEDAATYYCQQWRNNPFTFGSGTKVEIK

SEQ ID NO: 174 - DNA, 372 bp, Mus musculus
  misc_feature (1)..(372): SC16.65 VH
  CDS (1)..(372)
caggttactctgaaagagtctggccctgggatattgcagccctcccagaccctcagtctgacttgttctttctctgggttttcactgagcacttctggtatgggtgtaggctggattcgtcagccatcagggaagggtctggagtggctggcactcatttggtgggatgatgtcaagcgctataatccagccctgaagagtcgactgactatctccaaggatgcctccagcagccaggtcttcctcaagatcgccagtgtggacactgcagatactgccacatactactgtgctcgaatagcttcctatgattacgacgtagtctatgctatggactactggggtcaaggaacctcagtcagcgtctcctca

SEQ ID NO: 175 - protein, 124 aa, Mus musculus
QVTLKESGPGILQPSQTLSLTCSFSGFSLSTSGMGVGWIRQPSGKGLEWLALIWWDDVKRYNPALKSRLTISKDASSSQVFLKIASVDTADTATYYCARIASYDYDVVYAMDYWGQGTSVSVSS

SEQ ID NO: 176 - DNA, 327 bp, Mus musculus
  misc_feature (1)..(327): SC16.67 VL
  CDS (1)..(327)
caggctgttgtgactcaggaatctgcactcaccacatcacctggtgaaacagtcacactcacttgtcgctcaagtactggggctgttacaactagtaactatgccaactggatccaagaaaaaccagatcatttattcactggtctaataggtggtaccaacaaccgagctccaggtgttcctgccagattctcaggctccctgattggagacaaggctgccctcaccatcacaggggcacagactgaggatgaggcaatatatttctgtggtctatggtacagcaaccatttggtgttcggtggaggaaccaaactgactgtccta

SEQ ID NO: 177 - protein, 109 aa, Mus musculus
QAVVTQESALTTSPGETVTLTCRSSTGAVTTSNYANWIQEKPDHLFTGLIGGTNNRAPGVPARFSGSLIGDKAALTITGAQTEDEAIYFCGLWYSNHLVFGGGTKLTVL

SEQ ID NO: 178 - DNA, 351 bp, Mus musculus
  misc_feature (1)..(351): SC16.67 VH
  CDS (1)..(351)
gaggtgcagcttgttgagactggtggaggattggtgcagcctaaagggtcattgaaactctcatgtgcagtctctgcattcaccttcactacctacgccatgaactgggtccgccaggctccaggaaagggtttggagtgggttgctcgcataagaaataaaagtaataattatgcaacatattatgccgattcagtgaaagacaggttcaccatctccagagatgattcacaaagcatgctctatctgcaaatgaacaacttgaaaattgaggacacagccatgtattactgtgtgttctactatgattacgtctactggggccaagggactctggtcactgtctctgca

SEQ ID NO: 179 - protein, 117 aa, Mus musculus
EVQLVETGGGLVQPKGSLKLSCAVSAFTFTTYAMNWVRQAPGKGLEWVARIRNKSNNYATYYADSVKDRFTISRDDSQSMLYLQMNNLKIEDTAMYYCVFYYDYVYWGQGTLVTVSA

SEQ ID NO: 180 - DNA, 321 bp, Mus musculus
  misc_feature (1)..(321): SC16.68 VL
  CDS (1)..(321)
gaaacaactgtgacccagtctccagcattcctgtccgtggctacaggagaaaaagtcactatcagatgcataaccagcactgatattgatgatgatatgaactggtaccagcagaagccaggggaacctcctaatgtccttatttcagaaggcaatactcttcgtcctggagtcccatcccgattctccagcagtggctatggcacagattttgtttttacaattgaaaacacgctctcagaagatgttgcagattactactgtttgcaaagtgataacatgcctctcacgttcggtgctgggaccaagctggagctgaaa

SEQ ID NO: 181 - protein, 107 aa, Mus musculus
ETTVTQSPAFLSVATGEKVTIRCITSTDIDDDMNWYQQKPGEPPNVLISEGNTLRPGVPSRFSSSGYGTDFVFTIENTLSEDVADYYCLQSDNMPLTFGAGTKLELK

SEQ ID NO: 182 - DNA, 363 bp, Mus musculus
  misc_feature (1)..(363): SC16.68 VH
  CDS (1)..(363)
caggtgcaactgcagcagcctggggctgagctggtgaagcctggggcctcagtgaagatgtcctgcaaggcttctggctacacatttaccaattacaatatgcactgggtaaagcagacacctggacagggcctggaatggattggggctatttttccaggaaatggtggtacttcctacaatcagaagttcaaaggcaaggccacattgactgcagacaaatcctccagcacagcctacatgcagctcaccagtttgacatctggggactctgcagtctattactgtgcaagatggggctacggtagtggcctttatgctatggactactggggtcaaggaacctcagtcaccgtctcctca

SEQ ID NO: 183 - protein, 121 aa, Mus musculus
QVQLQQPGAELVKPGASVKMSCKASGYTFTNYNMHWVKQTPGQGLEWIGAIFPGNGGTSYNQKFKGKATLTADKSSSTAYMQLTSLTSGDSAVYYCARWGYGSGLYAMDYWGQGTSVTVSS

SEQ ID NO: 184 - DNA, 318 bp, Mus musculus
  misc_feature (1)..(318): SC16.72 VL
  CDS (1)..(318)
gaaaatgtactcacccagtctccagcaatcatgtctgcatctctaggggagaaggtcaccatgagctgcagggccagctcaagtgtaaattacatgtcctggtaccagcagaagtcagatgcctcccccaaactatggatttattacacatccaacctggctcctggagtcccagctcgcttcagtggcagtgggtctgggaactcttattctctcacaatcagcagcatggagggtgaagatgctgccacttattactgccagcagtttactagttccccgtacacgttcggaggggggaccaagctggaaataaaa

SEQ ID NO: 185 - protein, 106 aa, Mus musculus
ENVLTQSPAIMSASLGEKVTMSCRASSSVNYMSWYQQKSDASPKLWIYYTSNLAPGVPARFSGSGSGNSYSLTISSMEGEDAATYYCQQFTSSPYTFGGGTKLEIK

SEQ ID NO: 186 - DNA, 351 bp, Mus musculus
  misc_feature (1)..(351): SC16.72 VH
  CDS (1)..(351)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagattgaggtcgagggctatggactactggggtcaaggaacctcagtcaccgtctcctca

SEQ ID NO: 187 - protein, 117 aa, Mus musculus
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARLRSRAMDYWGQGTSVTVSS

SEQ ID NO: 188 - DNA, 321 bp, Mus musculus
  misc_feature (1)..(321): SC16.73 VL
  CDS (1)..(321)
gacatccagatgacccagtctccatcctccttatctgcctctctgggagagagagtcagtctcacttgtcgggcaagtcaggacattggttatagcttaaactggcttcagcaggaaccagatggaactattaaacgcctgatctacgccacatccagtttagattctggtgtccccaaaaggttcagtggcagtaggtctgggtcagattattctctcaccatcagcagccttgagtctgaagattttgtagactattactgtctacaatatgctagttctccgtggacgttcggtggaggcaccaagctggaaatcaaa

SEQ ID NO: 189 - protein, 107 aa, Mus musculus
DIQMTQSPSSLSASLGERVSLTCRASQDIGYSLNWLQQEPDGTIKRLIYATSSLDSGVPKRFSGSRSGSDYSLTISSLESEDFVDYYCLQYASSPWTFGGGTKLEIK

SEQ ID NO: 190 - DNA, 369 bp, Mus musculus
  misc_feature (1)..(369): SC16.73 VH
  CDS (1)..(369)
caggtgcagctgcagcagtctggagctgagctgatgaagcctggggcctcagtgaagatatcctgcaaggctaatggctacacattcagtagctactggatagagtggttaaggcagaggcctggacatggccttgagtggattggagagattttacctggaagtgataatagtaattataatgagaagttcaagggcaaggccacattcactgcagatacatcctccaacacagcctacatgcaactcagcagcctgacatctgaggaatctgccgtctattactgtacaaggggattacgacgagacggctcatattactatgttatggaacattggggtcaaggaacctcagtcaccgtctcctca

SEQ ID NO: 191 - protein, 123 aa, Mus musculus
QVQLQQSGAELMKPGASVKISCKANGYTFSSYWIEWLRQRPGHGLEWIGEILPGSDNSNYNEKFKGKATFTADTSSNTAYMQLSSLTSEESAVYYCTRGLRRDGSYYYVMEHWGQGTSVTVSS

SEQ ID NO: 192 - DNA, 321 bp, Mus musculus
  misc_feature (1)..(321): SC16.78 VL
  CDS (1)..(321)
gacatcaagatgacccagtctccatcttccatgtatgcatctctaggagagagagtcactatcacttgcaaggcgagtcaggacattaatagctatttaagctggttccagcagaagccagggagatctcctaagaccctgatctatcgtgcaaacagattggtagatggggtcccatcaaggttcagtggcagtggatctgggcaagattattctctcaccatcagcagcctggactatgaagatatgggaatttattattgtctacagtatgatgaatttccattcacgttcggctcggggacaaagttggarathaar

SEQ ID NO: 193 - protein, 107 aa, Mus musculus
DIKMTQSPSSMYASLGERVTITCKASQDINSYLSWFQQKPGRSPKTLIYRANRLVDGVPSRFSGSGSGQDYSLTISSLDYEDMGIYYCLQYDEFPFTFGSGTKLEIK

SEQ ID NO: 194 - DNA, 357 bp, Mus musculus
  misc_feature (1)..(357): SC16.78 VH
  CDS (1)..(357)
gaagtgaagctggtggagtctgggggaggcttagtgaagcctggagggtccctgaaactctcctgtgcagcctctggattcactttcggtcgctatgtcatgtcttgggttcgccagactccagaaaagaaactggagtgggtcgcatccattactagtggtggtactacctactatccagacagtgtgaagggccgattcaccatctccagagataatgccaggaacatcctgtacctacaaatgagcagtctgaggtctgaggacacggccatgtattactgtgcaagagtctactatcattacgacgacatctttgcttactggggccaagggactctggtcactgtctctgca

SEQ ID NO: 195 - protein, 119 aa, Mus musculus
EVKLVESGGGLVKPGGSLKLSCAASGFTFGRYVMSWVRQTPEKKLEWVASITSGGTTYYPDSVKGRFTISRDNARNILYLQMSSLRSEDTAMYYCARVYYHYDDIFAYWGQGTLVTVSA

SEQ ID NO: 196 - DNA, 336 bp, Mus musculus
  misc_feature (1)..(336): SC16.79 VL
  CDS (1)..(336)
gacattgtgatgtcacagtctccatcctccctggctgtgtcagcaggagagaaggtcactatgagctgcaaatccagtcagagtctgctcaacagtagaacccgaaagaactacttggcttggtaccagcagaaaccagggcagtctcctaaactgctgatctactgggcatccactagggaatctggggtccctgatcgcttcacaggcagtggatctgggacagatttcactctcaccatcagcagtgtgcaggctgaagacctggcagtttattactgcaagcaatcttataatctttacacgttcggaggggggaccaagctgaaaataaaa

SEQ ID NO: 197 - protein, 112 aa, Mus musculus
DIVMSQSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLKIK

SEQ ID NO: 198 - DNA, 348 bp, Mus musculus
  misc_feature (1)..(348): SC16.79 VH
  CDS (1)..(348)
gaggtccagctgcaacagtctggacctgagctggtgaagcctggggcttcagtgaagatatcctgcaagacttctggatacacattcactgaatacaccatgcactgggtgaagcagagccatggaaagagccttgagtggattggaggtattaatcctaacaatggtggtactagctacaaccagaagttcaagggcaaggccacattgactgtagacaagtcctccagcacagcctacatggagctccgcagcctgacatctgaggattctgcagtctattactgtgcaaggggtcccgcctggtttgcttactggggccaagggactctggtcactgtctctgca

SEQ ID NO: 199 - protein, 116 aa, Mus musculus
EVQLQQSGPELVKPGASVKISCKTSGYTFTEYTMHWVKQSHGKSLEWIGGINPNNGGTSYNQKFKGKATLTVDKSSSTAYMELRSLTSEDSAVYYCARGPAWFAYWGQGTLVTVSA

SEQ ID NO: 200 - DNA, 321 bp, Mus musculus
  misc_feature (1)..(321): SC16.80 VL
  CDS (1)..(321)
gaaacaactgtgacccagtctccagcatccctgtccatggctataggagaaaaagtcaccatcagatgcataaccagcactgatattgatgatgatatgatctggtaccagcagaagccaggggaacctcctaagctccttatttcagaaggcaatactcttcgtcctggagtcccatcccgattctccagcagtggctatggtacagattttgtttttacaattgaaaacatgctctcagaagatgttgccgattactactgtttgaaaagggatgacttgccttacacgttcggcggggggacacaggtggaaattaaa

SEQ ID NO: 201 - protein, 107 aa, Mus musculus
ETTVTQSPASLSMAIGEKVTIRCITSTDIDDDMIWYQQKPGEPPKLLISEGNTLRPGVPSRFSSSGYGTDFVFTIENMLSEDVADYYCLKRDDLPYTFGGGTQVEIK

SEQ ID NO: 202 - DNA, 351 bp, Mus musculus
  misc_feature (1)..(351): SC16.80 VH
  CDS (1)..(351)
gaggtccagctgcaacagtctggacctgagctggtgaagcctggaggttcaaagaagatatcctgcaaggcttctggttactcattcactggctacagtatgaactgggtgaagcagagccatggaaagaaccttgagtggattggacttattaatccttacagtggtggtactatctacaaccagaaattcaagggcaaggccacattaactgtagacaagtcatccagcacagcctacatggagctcctcagtctgacatctgaggactctgcagtctattactgtgcaagaaggagtgattacccgttagtttactggggccaagggactctggtcactgtctctgca

SEQ ID NO: 203 - protein, 117 aa, Mus musculus
EVQLQQSGPELVKPGGSKKISCKASGYSFTGYSMNWVKQSHGKNLEWIGLINPYSGGTIYNQKFKGKATLTVDKSSSTAYMELLSLTSEDSAVYYCARRSDYPLVYWGQGTLVTVSA

SEQ ID NO: 204 - DNA, 324 bp, Mus musculus
  misc_feature (1)..(324): SC16.81 VL
  CDS (1)..(324)
caaattgttctcacccagtctccagcaatcatgtctgcatctctaggggaacgggtcaccctgacctgcactgccagctcaagtgtaagttccagttacttgcactggtaccagcagaagccaggatcctcccccaaactctggatttatagcacatccaacctggcttctggagtcccaactcgcttcagtggcagtgggtctgggacctcttactctctcagaatcagcagcatggaggctgaagatgctgccacttattactgccaccagtataatcgttccccgctcacgttcggtgctgggaccaagctggagctgaaa

SEQ ID NO: 205 - protein, 108 aa, Mus musculus
QIVLTQSPAIMSASLGERVTLTCTASSSVSSSYLHWYQQKPGSSPKLWIYSTSNLASGVPTRFSGSGSGTSYSLRISSMEAEDAATYYCHQYNRSPLTFGAGTKLELK

SEQ ID NO: 206 - DNA, 351 bp, Mus musculus
  misc_feature (1)..(351): SC16.81 VH
  CDS (1)..(351)
caggtgcagctgaaggagtcaggacctgtcctggtggcgccctcacagagcctgtccatcacttgcactgtctctgggttttcattaaccagctatggtgtacactgggttcgccagcctccaggaaagggtctggagtggctgggagtaatttgggctggtggaagtacaaattataattcagctctcatgtccagactgagcatcagcaaagacaactccaagagccaagttttcttaaaaatgaacagtctgcaaactgatgacacagccatgtactactgtgccaaacagggcaacttctatgctatggactactggggtcaaggaacctcagtcaccgtctcctca

SEQ ID NO: 207 - protein, 117 aa, Mus musculus
QVQLKESGPVLVAPSQSLSITCTVSGFSLTSYGVHWVRQPPGKGLEWLGVIWAGGSTNYNSALMSRLSISKDNSKSQVFLKMNSLQTDDTAMYYCAKQGNFYAMDYWGQGTSVTVSS

SEQ ID NO: 208 - DNA, 318 bp, Mus musculus
  misc_feature (1)..(318): SC16.84 VL
  CDS (1)..(318)
gacatccagatgacacagtctccatcctcactgtctgcatctctgggaggcaaagtcaccatcacttgcaaggcaagccaagacattaagaagtatatagcttggtaccaacacaagcctggaaaaggtcctaggctactcatacattacacatctacattagagccaggcatcccatcaaggttcagtggaagtgggtctgggagagattattccttcagcatcagcaacctggagcctgaagatattgcaacttattattgtctacaatatgatattctgtggacgttcggtggaggcaccaagctggaaatcaaa

SEQ ID NO: 209 - protein, 106 aa, Mus musculus
DIQMTQSPSSLSASLGGKVTITCKASQDIKKYIAWYQHKPGKGPRLLIHYTSTLEPGIPSRFSGSGSGRDYSFSISNLEPEDIATYYCLQYDILWTFGGGTKLEIK

SEQ ID NO: 210 - DNA, 363 bp, Mus musculus
  misc_feature (1)..(363): SC16.84 VH
  CDS (1)..(363)
gaggtccagctgcaacagtctggacctgagctggtgaagcctggagcttcaatgaagatatcctgcaaggcttctggttactcattcactggctacaccatgaactgggtgaagcagagccatggaaagaaccttgagtggattggacttattaatccttacaatggtggtactacctacaaccagaagttcaagggcaaggccacattaactgtagacaagtcatccagcacagcctacatggagctcctcagtctgacatctgaggactctgcagtctattactgtgcattaggttactatggtaactacaggaggtacttcgatgtctggggcgcagggaccacggtcaccgtctcctca

SEQ ID NO: 211 - protein, 121 aa, Mus musculus
EVQLQQSGPELVKPGASMKISCKASGYSFTGYTMNWVKQSHGKNLEWIGLINPYNGGTTYNQKFKGKATLTVDKSSSTAYMELLSLTSEDSAVYYCALGYYGNYRRYFDVWGAGTTVTVSS

SEQ ID NO: 212 - DNA, 324 bp, Mus musculus
  misc_feature (1)..(324): SC16.88 VL
  CDS (1)..(324)
gaaaatgtgctcacccagtctccagcaataatggctgcctctctggggcagaaggtcaccatgacctgcagtgccagctcaagtgtaagttccagttacttgcactggtaccagcagaagtcaggcgcttcccccaaacccttgattcataggacatccaacctggcttctggagtcccagctcgcttcagtggcagtgggtctgggacctcttactctctcacaatcagcagcgtggaggctgaagatgatgcaacttattactgccggcagtggagtggttacccgtggacgttcggtggaggcaccaagctggaaatcaaa

SEQ ID NO: 213 - protein, 108 aa, Mus musculus
ENVLTQSPAIMAASLGQKVTMTCSASSSVSSSYLHWYQQKSGASPKPLIHRTSNLASGVPARFSGSGSGTSYSLTISSVEAEDDATYYCRQWSGYPWTFGGGTKLEIK

SEQ ID NO: 214 - DNA, 357 bp, Mus musculus
  misc_feature (1)..(357): SC16.88 VH
  CDS (1)..(357)
caggttcagctgcagcagtctggggctgagctggcaagacctggggcttcagtgaagttgtcctgcaaggcttctggctacacctgtactagctactggatgcagtgggtaaaacagaggcctggacagggtctggaatggattggggctatttatcctggagatggtgatactaggtacactcagaagttcaagggcaaggccacattgactgcagataaatcctccagcacagcctacatgcaactcagcagcttggcatctgaggactctgcggtctattactgtgcaagggggaggcggacggaggcctggtttgcttactggggccaagggactctggtcactgtctctgca

SEQ ID NO: 215 - protein, 119 aa, Mus musculus
QVQLQQSGAELARPGASVKLSCKASGYTCTSYWMQWVKQRPGQGLEWIGAIYPGDGDTRYTQKFKGKATLTADKSSSTAYMQLSSLASEDSAVYYCARGRRTEAWFAYWGQGTLVTVSA

SEQ ID NO: 216 - DNA, 324 bp, Mus musculus
  misc_feature (1)..(324): SC16.101 VL
  CDS (1)..(324)
caaattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgagtctgggacctcttactctctcacaatcagcaacatggaggctgaggatgctgccacttattactgccaccagtatcatcgttccccattcacgttcggctcggggacaaagttggaaataaaa

SEQ ID NO: 217 - protein, 108 aa, Mus musculus
QIVLTQSPAIMSASLGERVTMTCTASSSVSSSYLHWYQQKPGSSPKLWIYSTSNLASGVPARFSGSESGTSYSLTISNMEAEDAATYYCHQYHRSPFTFGSGTKLEIK

SEQ ID NO: 218 - DNA, 360 bp, Mus musculus
  misc_feature (1)..(360): SC16.101 VH
  CDS (1)..(360)
caggttactctgaaagagtctggccctgggatattgcagccctcccagaccctcagtctgacttgttctttctctggattttcactgagcacttctggtatgggcgtaggctggattcgtcagccatcagggaagggtctggagtggctggcacacatttggtgggatgatgtcaagcgctataacccagcccttaagagccgactgactatctccaaggatgcctccagcagccaggtattcctcaagatcgccagtgtggacactgcagaaactgccacatactactgtgcccacatcctcgaccgggcttactactttgactactggggccaaggcaccactctcacagtcacctca

SEQ ID NO: 219 - protein, 120 aa, Mus musculus
QVTLKESGPGILQPSQTLSLTCSFSGFSLSTSGMGVGWIRQPSGKGLEWLAHIWWDDVKRYNPALKSRLTISKDASSSQVFLKIASVDTAETATYYCAHILDRAYYFDYWGQGTTLTVTS

SEQ ID NO: 220 - DNA, 333 bp, Mus musculus
  misc_feature (1)..(333): SC16.103 VL
  CDS (1)..(333)
gacattgtgctgacacagtctcctgcttccttagctgtatctctggggcagagggccaccatctcatgcagggccagcaaaagtgtcagtacatctggctatagttatatgcactggtaccaacagaaaccaggacagccacccaaactcctcatctatcttgcatccaacctagaatctggggtccctgccaggttcagtggcagtgggtctgggacagacttcaccctcaacatccatcctgtggaggaggaggatgctgcaacctattactgtcagcacagtagggagcttcctctcacgttcggtgctgggaccaagctggagctgaaa

SEQ ID NO: 221 - protein, 111 aa, Mus musculus
DIVLTQSPASLAVSLGQRATISCRASKSVSTSGYSYMHWYQQKPGQPPKLLIYLASNLESGVPARFSGSGSGTDFTLNIHPVEEEDAATYYCQHSRELPLTFGAGTKLELK

SEQ ID NO: 222 - DNA, 357 bp, Mus musculus
  misc_feature (1)..(357): SC16.103 VH
  CDS (1)..(357)
caagttactctaaaagagtctggccctgggatattgaagccctcacagaccctcagtctgacttgttctttctctgggttttcactgagcacttctggtatgggtataggctggattcgtcagccttcagggaagggtctggagtggctggcacacatttggtgggatgatgataagtactataacccatccctgaagagccagctcacaatctccaaggattcctccagaaaccaggttttcctcaagatcaccagtgtggacactgcagatactgccacttactactgtgctcgaagagggactgcgtactactttgactactggggccaaggcaccactctcacagtctcctca

SEQ ID NO: 223 - protein, 119 aa, Mus musculus
QVTLKESGPGILKPSQTLSLTCSFSGFSLSTSGMGIGWIRQPSGKGLEWLAHIWWDDDKYYNPSLKSQLTISKDSSRNQVFLKITSVDTADTATYYCARRGTAYYFDYWGQGTTLTVSS

SEQ ID NO: 224 - DNA, 318 bp, Mus musculus
  misc_feature (1)..(318): SC16.104 VL
  CDS (1)..(318)
caaattgttctctcccagtctccagcaatcctgtctgcatctccaggggagaaggtcacaatgacttgcagggccagttcaagtgtaagttacattcactggtaccggcagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagcagtaatccacccacgttcggtgctgggaccaagctggagctgaaa

SEQ ID NO: 225 - protein, 106 aa, Mus musculus
QIVLSQSPAILSASPGEKVTMTCRASSSVSYIHWYRQKPGSSPKPWIYATSNLASGVPARFSGSGSGTSYSLTISRVEAEDAATYYCQQWSSNPPTFGAGTKLELK

SEQ ID NO: 226 - DNA, 345 bp, Mus musculus
  misc_feature (1)..(345): SC16.104 VH
  CDS (1)..(345)
caggtgcagctgaaggagtcaggacctgaccttgtgcagccctcacagaccctgtctctcacctgcactgtctctgggttctcattaaccttctatggtgttcactgggttcgccagcctccaggaaagggactggagtgggtgggaacaatgggctgggatgacaaaaaatattataattcagctctaaaatctcgactgagcatcagcagggatacctccaagaaccaggttttcttaaaactgagcagtctgcaaactgaagacacagccatgtactactgtactagaggtgggacggggtttgactactggggccaaggcaccactctcacagtctcctca

SEQ ID NO: 227 - protein, 115 aa, Mus musculus
QVQLKESGPDLVQPSQTLSLTCTVSGFSLTFYGVHWVRQPPGKGLEWVGTMGWDDKKYYNSALKSRLSISRDTSKNQVFLKLSSLQTEDTAMYYCTRGGTGFDYWGQGTTLTVSS

SEQ ID NO: 228 - DNA, 321 bp, Mus musculus
  misc_feature (1)..(321): SC16.105 VL
  CDS (1)..(321)
gacattgtgatgacccagtcgcacaaattcatgtccacatcagtaggagacagggtcagcatcacctgcaaggccagtcaggatgtgggtactgctgtagcctggtatcaacagaaaccagggcaatctcctaaactactgatttactgggcatccatccggcacactggagtccctgatcgcttcacaggcagtggatctgggacagatttcactctcaccattagcaatgtgcagtctgaagacttggcagattatttctgtcagcaatatagcagctatccgctcacgttcggtgctgggaccaagctggagctgaaa

SEQ ID NO: 229 - protein, 107 aa, Mus musculus
DIVMTQSHKFMSTSVGDRVSITCKASQDVGTAVAWYQQKPGQSPKLLIYWASIRHTGVPDRFTGSGSGTDFTLTISNVQSEDLADYFCQQYSSYPLTFGAGTKLELK

SEQ ID NO: 230 - DNA, 363 bp, Mus musculus
  misc_feature (1)..(363): SC16.105 VH
  CDS (1)..(363)
caggtccaactgcagcagcctggggctgagcttgtgaagcctggggcttcagtgaagctgtcctgcaaggcttctggctacaccttcaccagctactggatgcactgggtgaagcagaggcctggacaaggccttgagtggattggagtgattaatcctagcaacggtcgtactaactacaatgagaagttcaagagcaaggccacactgactgtagacaaatcctccagcacagcctacatgcaactcagcagcctgacatctgaggactctgcggtctattactgtgcaagaagaagggaactgggaaccctctatgctatggactactggggtcaaggaacctcagtcaccgtctcctca

SEQ ID NO: 231 - protein, 121 aa, Mus musculus
QVQLQQPGAELVKPGASVKLSCKASGYTFTSYWMHWVKQRPGQGLEWIGVINPSNGRTNYNEKFKSKATLTVDKSSSTAYMQLSSLTSEDSAVYYCARRRELGTLYAMDYWGQGTSVTVSS

SEQ ID NO: 232 - DNA, 321 bp, Mus musculus
  misc_feature (1)..(321): SC16.106 VL
  CDS (1)..(321)
gacatcaagatgacccagtctccatcttccatgtatgcatctctaggagagagagtcactatcacttgcaaggcgagtcaggacattaatagctatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccattcacgttcggctcggggacaaagttggaaataaaa

SEQ ID NO: 233 - protein, 107 aa, Mus musculus
DIKMTQSPSSMYASLGERVTITCKASQDINSYLSWFQQKPGKSPKTLIYRANRLVDGVPSRFSGSGSGQDYSLTISSLEYEDMGIYYCLQYDEFPFTFGSGTKLEIK

SEQ ID NO: 234 - DNA, 345 bp, Mus musculus
  misc_feature (1)..(345): SC16.106 VH
  CDS (1)..(345)
caggtgcaactgaagcagtcaggacctggcctggtggcgccctcacagagcctgttcatcacatgcaccgtctcagggttctcattaaccagctatgaaataaactgggttcgccagcctccaggaaagggtctggagtggctgggagtgatatggactggtggaagcacaaattataattcagctctcatatccagactgagcatcagcaaagacaactccaagagcctagttttcttaaaaatgaacagtctgcaaactgatgacacagccatatattactgtgtaagaggtgtttatgctatggactactggggtcaaggaacctcagtcaccgtctcctca

SEQ ID NO: 235 - protein, 115 aa, Mus musculus
QVQLKQSGPGLVAPSQSLFITCTVSGFSLTSYEINWVRQPPGKGLEWLGVIWTGGSTNYNSALISRLSISKDNSKSLVFLKMNSLQTDDTAIYYCVRGVYAMDYWGQGTSVTVSS

SEQ ID NO: 236 - DNA, 321 bp, Mus musculus
  misc_feature (1)..(321): SC16.107 VL
  CDS (1)..(321)
gacattgtgatgacccagtctcacaaattcatgtccacatcagtaggagacagggtcagcatcacctgcaaggccagtcaggatgtgaatactgctgtaggctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtagtccgtacacgttcggaggggggaccaaggtggaaataaaa

SEQ ID NO: 237 - protein, 107 aa, Mus musculus
DIVMTQSHKFMSTSVGDRVSITCKASQDVNTAVGWYQQKPGQSPKLLIYSASYRYTGVPDRFTGSGSGTDFTFTISSVQAEDLAVYYCQQHYSSPYTFGGGTKVEIK

SEQ ID NO: 238 - DNA, 357 bp, Mus musculus
  misc_feature (1)..(357): SC16.107 VH
  CDS (1)..(357)
gaggtccagctgcagcagtctggacctgagctggtaaagcctggggcttcagtgaagatgtcctgcaaggcttctggatacacattcactaactatgttatgcactgggtgaagcagaagcctgggcagggccttgagtggattggatatattaatccttacaatgatggtactaaatacaatgagaagttcaaaggcaaggccacactgacttcagacaaatcctccaccacagcctacatggcgctcagcagcctgacctctgaggactctgcggtctattactgtgcagtagcctactatagtaactgggggtttgcttactggggccaagggactctggtcactgtctctgca

SEQ ID NO: 239 - protein, 119 aa, Mus musculus
EVQLQQSGPELVKPGASVKMSCKASGYTFTNYVMHWVKQKPGQGLEWIGYINPYNDGTKYNEKFKGKATLTSDKSSTTAYMALSSLTSEDSAVYYCAVAYYSNWGFAYWGQGTLVTVSA

SEQ ID NO: 240 - DNA, 321 bp, Mus musculus
  misc_feature (1)..(321): SC16.108 VL
  CDS (1)..(321)
gacatccagatgactcagtctccagcctccctatctgcatctgtgggagaaactgtcaccatcacatgtcgagcaagtgagaatatttacagttatttagcatggtatcagcagaaacagggaaaatctcctcagctcctggtctataatgcaaaaaccttagcagaaggtgtgccatcaaggttcagtggcagtagatcaggctcacagttttctctgaagatcaacagcctgcagcctgaagattttgggagttattactgtcaacatcattatggtactccgtacacgttcggaggggggaccaagctggaaataaaa

SEQ ID NO: 241 - protein, 107 aa, Mus musculus
DIQMTQSPASLSASVGETVTITCRASENIYSYLAWYQQKQGKSPQLLVYNAKTLAEGVPSRFSGSRSGSQFSLKINSLQPEDFGSYYCQHHYGTPYTFGGGTKLEIK

SEQ ID NO: 242 - DNA, 360 bp, Mus musculus
  misc_feature (1)..(360): SC16.108 VH
  CDS (1)..(360)
caggttcagctggaggagtcaggggctgagctggcaagacctggggcttcagtgaagttgtcctgcaaggcttctggctatagctactggatgcagtggataaaacagaggcctggacagggtctggaatggattggggctatttatcctggaaatggtgatactaggtacactcagaagttcaagggcaaggccacattgactgcagataaatcctccagcacagcctacatgcaactcagcagcttggcatctgaggactctgcggtctattactgtgcaagatctccggcctactataggtacggcgagggctactttgactactggggccaaggcaccactctcacagtctcctca

SEQ ID NO: 243 - protein, 120 aa, Mus musculus
QVQLEESGAELARPGASVKLSCKASGYSYWMQWIKQRPGQGLEWIGAIYPGNGDTRYTQKFKGKATLTADKSSSTAYMQLSSLASEDSAVYYCARSPAYYRYGEGYFDYWGQGTTLTVSS

SEQ ID NO: 244 - DNA, 318 bp, Mus musculus
  misc_feature (1)..(318): SC16.109 VL
  CDS (1)..(318)
caaattgttctcacccagtctccagcaatcatgtctgcatctccaggggagaaggtcaccatgacctgcagtgccagctcaagtgtaagttacatgtactggtaccagcagaagccaggatcctcccccagactcctgatttatgacacatccaacctggcttctggagtccctgttcgcttcagtggcagtgggtctgggacctctttctctctcacaatcagccgaatggaggctgaagatactgccacttattactgccaggagtggagtggtaatccgctcacgttcggtgatgggaccaagctggagctgaaa

SEQ ID NO: 245 - protein, 106 aa, Mus musculus
QIVLTQSPAIMSASPGEKVTMTCSASSSVSYMYWYQQKPGSSPRLLIYDTSNLASGVPVRFSGSGSGTSFSLTISRMEAEDTATYYCQEWSGNPLTFGDGTKLELK

SEQ ID NO: 246 - DNA, 354 bp, Mus musculus
  misc_feature (1)..(354): SC16.109 VH
  CDS (1)..(354)
cagatccagttggtgcagtctggacctgagctgaagaagcctggagagacagtcaagatctcctgcaaggcttctgggtataccttcacaaactatggaatgaactgggtgaagcaggctccaggaaagggtttaaagtggatgggctggataaacacctacactggagagccagcatatgctgatgacttcaagggacggtttgccttctctttggaaacctctgccagcgctgcctatttgcagatcaacaacctcaaaaatgaggacacggctacttttttctgtgcaaatatgaggcccacgagggggtttgcttactgggggcaagggactctgggcactgtctctgca

SEQ ID NO: 247 - protein, 118 aa, Mus musculus
QIQLVQSGPELKKPGETVKISCKASGYTFTNYGMNWVKQAPGKGLKWMGWINTYTGEPAYADDFKGRFAFSLETSASAAYLQINNLKNEDTATFFCANMRPTRGFAYWGQGTLGTVSA

SEQ ID NO: 248 - DNA, 321 bp, Mus musculus
  misc_feature (1)..(321): SC16.110 VL
  CDS (1)..(321)
aatattgtgatgacccagactcccaaattcctgcttgtatcagcaggagacagggttaccataacctgcaaggccagtcagagtgtgagtaatgatgtagcttggtaccaacagaagccagggcagtctcctaaactgctgatatactatgcatccaatcgctacactggagtccctgatcgcttcactggcagtggatatgggacggatttcactttcaccatcagcactgtgcaggctgaagacctggcagtttatttctgtcagcaggattatagctctcctccgacgttcggtggaggcaccaagctggaaatcaaa

SEQ ID NO: 249 - protein, 107 aa, Mus musculus
NIVMTQTPKFLLVSAGDRVTITCKASQSVSNDVAWYQQKPGQSPKLLIYYASNRYTGVPDRFTGSGYGTDFTFTISTVQAEDLAVYFCQQDYSSPPTFGGGTKLEIK

SEQ ID NO: 250 - DNA, 354 bp, Mus musculus
  misc_feature (1)..(354): SC16.110 VH
  CDS (1)..(354)
gaggtccagctgcagcagtctggacctgggctagtgaggactggggcttcagtgaagatatcctgcaaggcttctggttactcattcactggttactacatgcactgggtcaagcagagccatggaaagagccttgagtggattggatatattagttgttacaatggtgctactacctacaaccagaacttcaagggcaaggccacatttattgtagacacatcctccagcacagcctacatgcagttcaacagcctgacatctgaggactctgcggtctattactgtgcaagatccgacggggggcatgctatggactactggggtcaaggaacctcagtcaccgtctcctca

SEQ ID NO: 251 - protein, 118 aa, Mus musculus
EVQLQQSGPGLVRTGASVKISCKASGYSFTGYYMHWVKQSHGKSLEWIGYISCYNGATTYNQNFKGKATFIVDTSSSTAYMQFNSLTSEDSAVYYCARSDGGHAMDYWGQGTSVTVSS

SEQ ID NO: 252 - DNA, 321 bp, Mus musculus
  misc_feature (1)..(321): SC16.111 VL
  CDS (1)..(321)
gacatccagatgactcagtctccagcctccctggctgcatctgtgggagaaactgtcaccatcacatgtcgagcaagtgagaacatttactacagtttagcatggtatcagcagaagcaagggaaatctcctcagctcctgatctataatgcaaacagcttggaagatggtgtcccatcgaggttcagtggcagtggatctgggacacagtattctatgaagatcaacagcatgcagcctgaagataccgcaacttatttctgtaagcagacttatgacgttccgctcacgttcggtgctgggaccaagctggagctgaaa

SEQ ID NO: 253 - protein, 107 aa, Mus musculus
DIQMTQSPASLAASVGETVTITCRASENIYYSLAWYQQKQGKSPQLLIYNANSLEDGVPSRFSGSGSGTQYSMKINSMQPEDTATYFCKQTYDVPLTFGAGTKLELK

SEQ ID NO: 254 - DNA, 351 bp, Mus musculus
  misc_feature (1)..(351): SC16.111 VH
  CDS (1)..(351)
gaggttcagctgcagcagtctggacctgagctggagaagcctggcgcttcagtgaagatatcctgcaaggcttctggttactcattcactggctacaacatgaactgggtgaagcagagcaatggaaagagccttgagtggattggaaatattgatccttattatggtggttctagctacaaacagaagttcgagggcaaggccacattgactgtagacaaatcctccagcacagcctacatgcagctcaagagcctgacatctgaggactctgcagtctattactgtgcaagaggtggtagtaacttctttgactactggggccaaggcaccactctcacagtctcctca

SEQ ID NO: 255 - protein, 117 aa, Mus musculus
EVQLQQSGPELEKPGASVKISCKASGYSFTGYNMNWVKQSNGKSLEWIGNIDPYYGGSSYKQKFEGKATLTVDKSSSTAYMQLKSLTSEDSAVYYCARGGSNFFDYWGQGTTLTVSS

SEQ ID NO: 256 - DNA, 336 bp, Mus musculus
  misc_feature (1)..(336): SC16.113 VL
  CDS (1)..(336)
gatgttgtgatgacccagactccactcactttgtcggttaccattggacaaccagcctccatctcttgcaagtcaagtcagagcctcttagatagtgatggaacgacatatttgaattggttgttacagaggccaggccagtctccaaagcgcctaatctatctggtgtctaaactggactctggagtccctgacaggttcactggcagtggatcagggacagatttcacactgaaaatcagcagagtggaggctgaggatttgggagtttattattgctggcaaggtacacattttccgctcacgttcggtgctgggaccaagctggagctgaaa

SEQ ID NO: 257 - protein, 112 aa, Mus musculus
DVVMTQTPLTLSVTIGQPASISCKSSQSLLDSDGTTYLNWLLQRPGQSPKRLIYLVSKLDSGVPDRFTGSGSGTDFTLKISRVEAEDLGVYYCWQGTHFPLTFGAGTKLELK

SEQ ID NO: 258 - DNA, 351 bp, Mus musculus
  misc_feature (1)..(351): SC16.113 VH
  CDS (1)..(351)
gacgtgaagctggtggagtctgggggaggcttagtgaagcctggagggtccctgaaactctcctgtgcagcctctggattcactttcagtagctataccatgtcttgggttcgccagactccggagaagaggctggagtgggtcgcaaccattagtagtggtggtagttacccctactatccagacagtgtgaagggccgattcaccatctccagagacaatgccaagaacaccctgtacctgcaaatgagcagtctgaagtctgaggacacagccatgtattactgtacaagagatgtctatgatggttactcctactggggccaaggcaccactctcacagtctcctca

SEQ ID NO: 259 - protein, 117 aa, Mus musculus
DVKLVESGGGLVKPGGSLKLSCAASGFTFSSYTMSWVRQTPEKRLEWVATISSGGSYPYYPDSVKGRFTISRDNAKNTLYLQMSSLKSEDTAMYYCTRDVYDGYSYWGQGTTLTVSS

SEQ ID NO: 260 - DNA, 318 bp, Mus musculus
  misc_feature (1)..(318): SC16.114 VL
  CDS (1)..(318)
caaattgttctctcccagtctccagcaatcctgtctgcatctccaggggagaaggtcacaatgacttgcagggccagctcaagtgtaagttacatgcactggtaccagcagaagccaggatcctcccccaaaccctggatttatgccacatccaacctggcttctggagtccctgctcgcttcagtggcagtgggtctgggacctcttactctctcacaatcagcagagtggaggctgaagatgctgccacttattactgccagcagtggagtagtaacccatacacgttcggaggggggaccaagctggaaataaaa

SEQ ID NO: 261 - protein, 106 aa, Mus musculus
QIVLSQSPAILSASPGEKVTMTCRASSSVSYMHWYQQKPGSSPKPWIYATSNLASGVPARFSGSGSGTSYSLTISRVEAEDAATYYCQQWSSNPYTFGGGTKLEIK

SEQ ID NO: 262 - DNA, 369 bp, Mus musculus
  misc_feature (1)..(369): SC16.114 VH
  CDS (1)..(369)
gaggttcagctgcagcagtctggggcagaacttgtgaagccaggggcctcagtcaaattgtcctgcacagcttctggcttcaacattaaagacacctatatacactgggtgaaacagaggcctgaacagggcctggagtggattggaaggattgatcctgcgaatggtaatactaaatatgacccgaagttccagggcaaggccactataacaccagacacatcctccaacacagcctacctgcagctcagcagcctgacatctgaggacactgccgtctattactgtgctagaagctggcgaaactacggtagtagtttctggtacttcgatgtctggggcgcagggaccacggtcaccgtctcctca

SEQ ID NO: 263 - protein, 123 aa, Mus musculus
EVQLQQSGAELVKPGASVKLSCTASGFNIKDTYIHWVKQRPEQGLEWIGRIDPANGNTKYDPKFQGKATITPDTSSNTAYLQLSSLTSEDTAVYYCARSWRNYGSSFWYFDVWGAGTTVTVSS

SEQ ID NO: 264 - DNA, 336 bp, Mus musculus; identical to SEQ ID NO: 256
  misc_feature (1)..(336): SC16.115 VL
  CDS (1)..(336)

SEQ ID NO: 265 - protein, 112 aa, Mus musculus; identical to SEQ ID NO: 257

SEQ ID NO: 266 - DNA, 351 bp, Mus musculus; identical to SEQ ID NO: 258
  misc_feature (1)..(351): SC16.115 VH
  CDS (1)..(351)

SEQ ID NO: 267 - protein, 117 aa, Mus musculus; identical to SEQ ID NO: 259

SEQ ID NO: 268 - DNA, 333 bp, Mus musculus
  misc_feature (1)..(333): SC16.116 VL
  CDS (1)..(333)
gacattgtgatgacacagtctccatcctccctgactgtgacagcaggagagaaggtcactatgagctgcacgtccagtcagagtctgttaaccagtggaaatcaaaagaactacttgacctggtaccagcagaaaccagggcagcctcctaaactgttgatctactgggcatccactagggaatctggggtccctgatcgcttcacaggcagtggatctggaacagatttcactctcaccatcagcagtttgcaggctgaagacctggcagtttattactgtcagaatgattatagtctcacgttcggtgctgggaccaagctggagctgaaa

SEQ ID NO: 269 - protein, 111 aa, Mus musculus
DIVMTQSPSSLTVTAGEKVTMSCTSSQSLLTSGNQKNYLTWYQQKPGQPPKLLIYWASTRESGVPDRFTGSGSGTDFTLTISSLQAEDLAVYYCQNDYSLTFGAGTKLELK

SEQ ID NO: 270 - DNA, 354 bp, Mus musculus
  misc_feature (1)..(354): SC16.116 VH
  CDS (1)..(354)
caggtgcagctgaagcagtcaggacctggccgagtgcagccctcacagagcctgtccatcacctgcacagtctctggtttttcattaactagcaatggtgtacactgggttcgccagtctccaggaaagggtctggagtggctgggagtgctatggagtggtggaagcacagactataatgcagctttcatatccagactgagcatcagcaaggacaattacaagagccaagttttctttaaaatgaacagtctgcaagctaatgacacagccatatattactgtgccagaaataataataggtacggagctatggactactggggtcaaggaacctcagtcaccgtctcctca

SEQ ID NO: 271 - protein, 118 aa, Mus musculus
QVQLKQSGPGRVQPSQSLSITCTVSGFSLTSNGVHWVRQSPGKGLEWLGVLWSGGSTDYNAAFISRLSISKDNYKSQVFFKMNSLQANDTAIYYCARNNNRYGAMDYWGQGTSVTVSS

SEQ ID NO: 272 - DNA, 321 bp, Mus musculus
  misc_feature (1)..(321): SC16.117 VL
  CDS (1)..(321)
gacatccagatgaaccagtctccatccagtctgtctgcatcccttggagacacaattaccatcacttgccatgtcagtcagaacattaatgtttggttaagctggtaccagcagaaaccaggaaatattcctaaactattgatccaaaaggcttccaacttgcacacaggcgtcccctcaaggtttagtggcagtggatctggaacaggtttcacattaaccatcagcagcctgcagcctgaagacattgccacttactactgtcaacagggtcaaagttatccattcacgttcggctcggggacaaagttggaaataaaa

SEQ ID NO: 273 - protein, 107 aa, Mus musculus
DIQMNQSPSSLSASLGDTITITCHVSQNINVWLSWYQQKPGNIPKLLIQKASNLHTGVPSRFSGSGSGTGFTLTISSLQPEDIATYYCQQGQSYPFTFGSGTKLEIK

SEQ ID NO: 274 - DNA, 351 bp, Mus musculus
  misc_feature (1)..(351): SC16.117 VH
  CDS (1)..(351)
caggtgcagctgaaggagtcaggacctggcctggtggcgccctcacagagcctgtccatcacttgcactgtctctgggttttcattaaccaactatggtgtacactgggttcgccagcctccaggaaagggtctggagtggctgggagtaatatgggctggtggaatcacaaattataattcggctctcatgtccagactgagcatcagcgaagacaactccaagagccaagttttcttaaaaatgaacagtctgcaaactgatgacacagccatgtactactgtgccagaaatttaggtccctatgctatggactactggggtcaaggaacctcagtcaccgtctcctca

SEQ ID NO: 275 - protein, 117 aa, Mus musculus
QVQLKESGPGLVAPSQSLSITCTVSGFSLTNYGVHWVRQPPGKGLEWLGVIWAGGITNYNSALMSRLSISEDNSKSQVFLKMNSLQTDDTAMYYCARNLGPYAMDYWGQGTSVTVSS

SEQ ID NO: 276 - DNA, 333 bp, Mus musculus
  misc_feature (1)..(333): SC16.118 VL
  CDS (1)..(333)
gacattgtgctgacccaatctccagcttctttggctgtgtctctagggcagagggccaccatctcctgcaaggccagccaaagtgttgattatgatggtgatagttatttgacctggtaccaacagaaaccaggacagccacccaaactcctcatctatgctgcatccaatctagaatctgggatcccagccaggtttagtggcagtgggtctgggacagacttcaccctcaacatccatcctgtggaggaggaggacgctgcaacctattactgtcagcaaagtaatgaggatccgtacacgttcggaggggggaccaagctggaaataaaa

SEQ ID NO: 277 - protein, 111 aa, Mus musculus
DIVLTQSPASLAVSLGQRATISCKASQSVDYDGDSYLTWYQQKPGQPPKLLIYAASNLESGIPARFSGSGSGTDFTLNIHPVEEEDAATYYCQQSNEDPYTFGGGTKLEIK

SEQ ID NO: 278 - DNA, 351 bp, Mus musculus
  misc_feature (1)..(351): SC16.118 VH
  CDS (1)..(351)
gaggtccagctgcagcagtctggacctgacctggtgaagcctggggcttcagtgaagatatcctgcaaggcttctggttactcattcactggctactacatgcactgggtgaagcagagccatggaaagagccttgagtggattggacgtgttaatcctaacaatggtggtactagctacaaccagaagttcaagggcaaggccatattaactgcagacaagtcatccagcacagcctacatggagctccgcagcctgacatctgaggactctgcggtctattactgtgcaagagggagttatgattacgccgagggctggggccaagggactctggtcactgtctctgca

SEQ ID NO: 279 - protein, 117 aa, Mus musculus
EVQLQQSGPDLVKPGASVKISCKASGYSFTGYYMHWVKQSHGKSLEWIGRVNPNNGGTSYNQKFKGKAILTADKSSSTAYMELRSLTSEDSAVYYCARGSYDYAEGWGQGTLVTVSA

SEQ ID NO: 280 - DNA, 339 bp, Mus musculus
  misc_feature (1)..(339): SC16.120 VL
  CDS (1)..(339)
gacattgtgatgtcacagtctccatcctccctagctgtgtcagttggagagaaggttactatgagctgcaagtccagtcagagccttttatatagtagcactcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatccgtacacgttcggaggggggaccaagctggaaataaaa

SEQ ID NO: 281 - protein, 113 aa, Mus musculus
DIVMSQSPSSLAVSVGEKVTMSCKSSQSLLYSSTQKNYLAWYQQKPGQSPKLLIYWASTRESGVPDRFTGSGSGTDFTLTISSVKAEDLAVYYCQQYYSYPYTFGGGTKLEIK

SEQ ID NO: 282 - DNA, 351 bp, Mus musculus
  misc_feature (1)..(351): SC16.120 VH
  CDS (1)..(351)
gagatccagctgcagcagtctggacctgagctggtgaagcctggggcttcagtgaaggtatcctgcaaggcttctggttatgcattcactagctacaacatgtactgggtgatgcagagccatggaaagagccttgagtggattggatatgttgatccttacaatggtggtactagctacaaccagaagttcaagggcaaggccacattgactgttgacaagtcctccagcacagcctacatgcatctcaacagcctgacatctgaggactctgcagtctattactgtgcaagagaaaactataggtactttgactactggggccaaggcaccactctcacagtctcctca

SEQ ID NO: 283 - protein, 117 aa, Mus musculus
EIQLQQSGPELVKPGASVKVSCKASGYAFTSYNMYWVMQSHGKSLEWIGYVDPYNGGTSYNQKFKGKATLTVDKSSSTAYMHLNSLTSEDSAVYYCARENYRYFDYWGQGTTLTVSS

SEQ ID NO: 284 - DNA, 318 bp, Mus musculus
  misc_feature (1)..(318): SC16.121 VL
  CDS (1)..(318)
caaattgttctcacccagtctccagcaatcatgtctgcatctccaggggagaaggtcaccataacctgcagtgccagctcaagtgtaagttacatgcactggttccagcagaagccaggcacttctcccaaactctggatttatagcacatccaacctggcttctggagtccctgctcgcttcagtggcagtggatctgggacctcttactctctcacaatcagccgaatggaggctgaagatgctgccacttattactgccagcaaaggagtagttacccacccacgttcggaggggggaccaagctggaaataaar

SEQ ID NO: 285 - protein, 106 aa, Mus musculus
QIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIK

SEQ ID NO: 286 - DNA, 372 bp, Mus musculus
  misc_feature (1)..(372): SC16.121 VH
  CDS (1)..(372)
gaggtgcagcttgttgagtctggtggaggattggtgcagcctaaagggtcattgaaactctcatgtgcagcctctggattcaccttcaatacctacgccatgaactgggtccgccaggctccaggaaagggtttggaatgggttgctcgcataagaattaaaagtaataattatgcaacatattatgccgattcagtaaaagacaggttcaccatctccagagatgattcacaaaacatgctctatctgcaaatgaacaacttgaaaactgaggacacagccgtgtattactgtgtgagacaaggctatagttacgactggggaccctggtttgcttactggggccaagggactctggtcactgtctctgca

SEQ ID NO: 287 - protein, 124 aa, Mus musculus
EVQLVESGGGLVQPKGSLKLSCAASGFTFNTYAMNWVRQAPGKGLEWVARIRIKSNNYATYYADSVKDRFTISRDDSQNMLYLQMNNLKTEDTAVYYCVRQGYSYDWGPWFAYWGQGTLVTVSA

SEQ ID NO: 288 - DNA, 321 bp, Mus musculus
  misc_feature (1)..(321): SC16.122 VL
  CDS (1)..(321)
gacattgtgatgacccagtctcaaaaattcatgtccacatcagtaggagacagggtcagcgtcacctgcaaggccagtcagaatgtgggtactaatgtagcctggtatcaacagaaaccagggcaatctcctaaagtactgatttactcggcatcctaccggtacagtggagtccctgatcgcttcacaggcagtggatctgggacagatttcactctcaccatcagcaatgtgcagtctgaagacttggcagagtttttctgtcagcaatataacagctatcctctgacgttcggtggaggcaccaagctggaaatcaaa

SEQ ID NO: 289 - protein, 107 aa, Mus musculus
DIVMTQSQKFMSTSVGDRVSVTCKASQNVGTNVAWYQQKPGQSPKVLIYSASYRYSGVPDRFTGSGSGTDFTLTISNVQSEDLAEFFCQQYNSYPLTFGGGTKLEIK

SEQ ID NO: 290 - DNA, 354 bp, Mus musculus
  misc_feature (1)..(354): SC16.122 VH
  CDS (1)..(354)
gaagtgcagctggtggagtctgggggaggcttagtgaagcctggagggtccctgaaactctcctgtgcagcctctggattcactttcagtgactattacatgttttgggttcgccagactccggaaaagaggctggagtgggtcgcaaccattagtgatggtggtagttacacctactttccagacagtgtgaaggggcgattcaccatctccagagacaatgcccagaacaacctgtacctgcaaatgagcagtctgaagtctgaggacacagccatgtattactgtgcaagagccgggaccctctatgctatggactactggggtcaaggaacctcagtcaccgtctcctca

SEQ ID NO: 291 - protein, 118 aa, Mus musculus
EVQLVESGGGLVKPGGSLKLSCAASGFTFSDYYMFWVRQTPEKRLEWVATISDGGSYTYFPDSVKGRFTISRDNAQNNLYLQMSSLKSEDTAMYYCARAGTLYAMDYWGQGTSVTVSS

SEQ ID NO: 292 - DNA, 324 bp, Mus musculus
  misc_feature (1)..(324): SC16.123 VL
  CDS (1)..(324)
caaattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggagactgaagatgctgccacttattactgccaccagtatcatcgttcccccttcacgttcggctcggggacaaagttggaaataaaa

SEQ ID NO: 293 - protein, 108 aa, Mus musculus
QIVLTQSPAIMSASLGERVTMTCTASSSVSSSYLHWYQQKPGSSPKLWIYSTSNLASGVPARFSGSGSGTSYSLTISSMETEDAATYYCHQYHRSPFTFGSGTKLEIK

SEQ ID NO: 294 - DNA, 366 bp, Mus musculus
  misc_feature (1)..(366): SC16.123 VH
  CDS (1)..(366)
caggttgctctgaaagagtctggccctgggatattgcagccctcccagaccctcagtctgacttgttctttctctgggttttcactgagcacttctggtatgggtgtaggctggattcgtcagccatcagggaagggtctggagtggctggcacacatttggtgggatgatgtcaagcgctataacccagccctgaagagccgactgactatctccaaggatacctccagcagccaggtattcctcaagatcgccagtgtggacactgcagatactgccacatactactgtgctcgaatggaggactacggtagtagctcctactttgacttctggggccacggcaccactctcacagtctcctca

SEQ ID NO: 295 - protein, 122 aa, Mus musculus
QVALKESGPGILQPSQTLSLTCSFSGFSLSTSGMGVGWIRQPSGKGLEWLAHIWWDDVKRYNPALKSRLTISKDTSSSQVFLKIASVDTADTATYYCARMEDYGSSSYFDFWGHGTTLTVSS

SEQ ID NO: 296 - DNA, 321 bp, Mus musculus
  misc_feature (1)..(321): SC16.124 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttctgctgcaaccagcttggcagatggggtcccatcaaggttcagtggtagtggatctggcacaaaattttctttcaagatcagcagcctacaggctgaagattttgtaagttattactgtcaacaactttacagtactccgtggacgttcggtggaggcaccaagctggaaatcaaa

SEQ ID NO: 297 - protein, 107 aa, Mus musculus
DIQMTQSPASQSASLGESVTITCLASQTIGTWLAWYQQKPGKSPQLLISAATSLADGVPSRFSGSGSGTKFSFKISSLQAEDFVSYYCQQLYSTPWTFGGGTKLEIK

SEQ ID NO: 298 - DNA, 369 bp, Mus musculus
  misc_feature (1)..(369): SC16.124 VH
  CDS (1)..(369)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagaggggctctctactatggtaactacctcgggtacttcgatgtctggggcgcagggaccacggtcaccgtctcctca

SEQ ID NO: 299 - protein, 123 aa, Mus musculus
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARGALYYGNYLGYFDVWGAGTTVTVSS

SEQ ID NO: 300 - DNA, 321 bp, Mus musculus
  misc_feature (1)..(321): SC16.125 VL
  CDS (1)..(321)
gacatccagatgaaccagtctccatccagtctgtctgcatcccttggagacacaattaccatcacttgccatgccagtcagaacattaatgtttggttaagctggtaccagcagaaaccaggaaatattcctaaactattgatctataaggcttccatcttacacacaggcgtcccatcaaggtttagtggcagtggatctggaacaggtttcacattaaccatcagcagcctgcagcctgaagacattgccacttactcctgtcaacagggtcaaagttatccgtacacgttcggaggggggaccaagctggaaataaaa

SEQ ID NO: 301 - protein, 107 aa, Mus musculus
DIQMNQSPSSLSASLGDTITITCHASQNINVWLSWYQQKPGNIPKLLIYKASILHTGVPSRFSGSGSGTGFTLTISSLQPEDIATYSCQQGQSYPYTFGGGTKLEIK

SEQ ID NO: 302 - DNA, 354 bp, Mus musculus
  misc_feature (1)..(354): SC16.125 VH
  CDS (1)..(354)
gatgtgcagcttcaggagtcaggacctgacctggtgaaaccttctcagtcactttcactcacctgcactgtcactggctactccatcaccagtggttatagctggcactggatccggcagtttccaggaaacaaactggaatggatgggctacatacactacagtggtagcactaactacaacccatctctcaaaagtcgaatctctatcactcgagacacatccaagaaccagttcttcctgcagttcaaatctgtgactactgaagactcagccacatattactgtgccctagaggggaattacgacgggtttgcttactggggccaagggactctggtcactgtctcttcn

SEQ ID NO: 303 - protein, 118 aa, Mus musculus
  misc_feature (118)..(118): The 'Xaa' at location 118 stands for Ser.
DVQLQESGPDLVKPSQSLSLTCTVTGYSITSGYSWHWIRQFPGNKLEWMGYIHYSGSTNYNPSLKSRISITRDTSKNQFFLQFKSVTTEDSATYYCALEGNYDGFAYWGQGTLVTVSX

SEQ ID NO: 304 - DNA, 321 bp, Mus musculus
  misc_feature (1)..(321): SC16.126 VL
  CDS (1)..(321)
gacatccagatgaaccagtctccatccagtctgtctgcatcccttggagacacaattaccatcacttgccatgccagtcagaacataaatgtttggttaagctggtaccagcagaaaccaggaaatattcctaaactattgatctataaggcttccaacttgcacacaggcgtcccatcaaggtttagtggcagtggatctggaacaggtttcacattaaccatcagcagcctgcagcctgaagacattgccacttactactgtcaacagggtcaaagttatccattcacgttcggctcggggacaaagttggaaataaaa

SEQ ID NO: 305 - protein, 107 aa, Mus musculus
DIQMNQSPSSLSASLGDTITITCHASQNINVWLSWYQQKPGNIPKLLIYKASNLHTGVPSRFSGSGSGTGFTLTISSLQPEDIATYYCQQGQSYPFTFGSGTKLEIK

SEQ ID NO: 306 - DNA, 348 bp, Mus musculus
  misc_feature (1)..(348): SC16.126 VH
  CDS (1)..(348)
caggtgcagatgaaggagtcaggacctggcctggtggcgccctcacagagcctgtccatcacttgcactgtctctgggtcttcattaaccaactatggtgtacactgggttcgccagcctccaggaaagggtctagagtggctgggagtaatatgggctggtggaagcacaaattataattcggctctcatgtccagactgagtatcagcaaagacaactccaagagccaagttttcttaaaaatgaacagtctgcaaactgatgacacagccatgtactactgtgccagagactgggagggctggtttgcttactggggccaagggactctggtcactgtctctgca

SEQ ID NO: 307 - protein, 116 aa, Mus musculus
QVQMKESGPGLVAPSQSLSITCTVSGSSLTNYGVHWVRQPPGKGLEWLGVIWAGGSTNYNSALMSRLSISKDNSKSQVFLKMNSLQTDDTAMYYCARDWEGWFAYWGQGTLVTVSA

SEQ ID NO: 308 - DNA, 321 bp, Mus musculus
  misc_feature (1)..(321): SC16.129 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttatgctgcaaccagcttggcagatggggtcccatcaaggttcagtggtagtggatctggcacaaaattttctttcaagatcagcagcctacaggctgaagattttgtaagttattactgtcaacaactttacagtactccgtacacgttcggaggggggaccaagctggaaataaaa

SEQ ID NO: 309 - protein, 107 aa, Mus musculus
DIQMTQSPASQSASLGESVTITCLASQTIGTWLAWYQQKPGKSPQLLIYAATSLADGVPSRFSGSGSGTKFSFKISSLQAEDFVSYYCQQLYSTPYTFGGGTKLEIK

SEQ ID NO: 310 - DNA, 348 bp, Mus musculus
  misc_feature (1)..(348): SC16.129 VH
  CDS (1)..(348)
caggtgcagctaaaggagtcaggacctggcctggtggcgccctcacagagcctgtccatcacatgcactgtctcagggttctcattaaccgactatggtgtaagctggattcgccagcctccaggaaagggtctggagtggctgggagtaatatggggtggtggaagcacatactataattcagctctcaaatccagactgagcatcagcaaggacaactccaagagccaagttttcttagaactgaacagtctgcaaactgatgacacagccatttactactgtgccaaacattatggtcactacgctgcttactggggccaagggactctggtcactgtctctgca

SEQ ID NO: 311 - protein, 116 aa, Mus musculus
QVQLKESGPGLVAPSQSLSITCTVSGFSLTDYGVSWIRQPPGKGLEWLGVIWGGGSTYYNSALKSRLSISKDNSKSQVFLELNSLQTDDTAIYYCAKHYGHYAAYWGQGTLVTVSA

SEQ ID NO: 312 - DNA, 321 bp, Mus musculus
  misc_feature (1)..(321): SC16.130 VL
  CDS (1)..(321)
gacatccagttgactcagtctccagcctccctatctgcatctgtgggagaaactgtcaccatcacatgtcgagcaagtgggagtattcacaattatttagcatggtatcagcagaaacagggaaagtctcctcagctcctggtctataatgcaaaaaccttagtagatggtgtgccatcaaggttcagtggcagtggatcaggaacacaatattctctcaagatcaacagcctgcagcctgaagattttgggtattattactgtcaacatttttggactactccgtggacattcggtggaggcaccaagctggaaatcaaa

SEQ ID NO: 313 - protein, 107 aa, Mus musculus
DIQLTQSPASLSASVGETVTITCRASGSIHNYLAWYQQKQGKSPQLLVYNAKTLVDGVPSRFSGSGSGTQYSLKINSLQPEDFGYYYCQHFWTTPWTFGGGTKLEIK

SEQ ID NO: 314 - DNA, 360 bp, Mus musculus
  misc_feature (1)..(360): SC16.130 VH
  CDS (1)..(360)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactgagtacaatgagaagttcaaaggcaaggccacactgacttcagacaaatcctccagcacagcctacatggagctcagcagcctgacctctgaggactctgcggtctattactgtgcaagaggggtctatgatggttactcttactttgactactggggccaaggcaccactctcacagtctcctca

SEQ ID NO: 315 - protein, 120 aa, Mus musculus
EVQLQQSGPELVKPGASVKMSCKASGYTFTSYVMHWVKQKPGQGLEWIGYINPYNDGTEYNEKFKGKATLTSDKSSSTAYMELSSLTSEDSAVYYCARGVYDGYSYFDYWGQGTTLTVSS

SEQ ID NO: 316 - DNA, 321 bp, Mus musculus; identical to SEQ ID NO: 272
  misc_feature (1)..(321): SC16.131 VL
  CDS (1)..(321)

SEQ ID NO: 317 - protein, 107 aa, Mus musculus; identical to SEQ ID NO: 273

SEQ ID NO: 318 - DNA, 351 bp, Mus musculus; identical to SEQ ID NO: 274
  misc_feature (1)..(351): SC16.131 VH
  CDS (1)..(351)

SEQ ID NO: 319 - protein, 117 aa, Mus musculus; identical to SEQ ID NO: 275

SEQ ID NO: 320 - DNA, 321 bp, Mus musculus
  misc_feature (1)..(321): SC16.132 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttatgctgcaaccagcttggcagatggggtcccatcaaggttcagtggtagtggatctggcacaaaattttctttcaagatcagcagcctacaggctgaagattttgtaagttattactgtcaacaactttacagtactccgtggacgttcggtggaggcaccaagctggagatcaaa

SEQ ID NO: 321 - protein, 107 aa, Mus musculus
DIQMTQSPASQSASLGESVTITCLASQTIGTWLAWYQQKPGKSPQLLIYAATSLADGVPSRFSGSGSGTKFSFKISSLQAEDFVSYYCQQLYSTPWTFGGGTKLEIK

SEQ ID NO: 322 - DNA, 348 bp, Mus musculus
  misc_feature (1)..(348): SC16.132 VH
  CDS (1)..(348)
caggtgcagctgaaggagtcaggacctggcctggtggcgccctcacagagcctgtccatcacatgcactgtctcagggttctcattaaccgactatggtgtaagctggattcgccagcctccaggaaagggtctggagtggctgggagtagtatggggtggtggaagcacatactataattccgctctcaaatccagactgagcatcaccaaggacaactccaagagccaagttttcttaaaaatgaacagtctgcaaactgatgacacagccatgtactactgtgccaaacagaggggtcagtacggggcttactggggccaagggactctggtcactgtctctgca

SEQ ID NO: 323 - protein, 116 aa, Mus musculus
QVQLKESGPGLVAPSQSLSITCTVSGFSLTDYGVSWIRQPPGKGLEWLGVVWGGGSTYYNSALKSRLSITKDNSKSQVFLKMNSLQTDDTAMYYCAKQRGQYGAYWGQGTLVTVSA

SEQ ID NO: 324 - DNA, 321 bp, Mus musculus
  misc_feature (1)..(321): SC16.133 VL
  CDS (1)..(321)
agtattgtgatgacccagactcccaaattcctgcttgtttcagcaggagacagggttaccataacctgcaaggccagtcagagtgtgagtaatgatgtagcttggtaccaacagaagccagggcagtctcctaaactgctgatatactgtgcatccaatcgctacactggagtccctgatcgcttcactggcagtggatatgggacggatttcactttcaccatcagcactgtgcaggctgaagacctggcagtttatttctgtcagcaggattatagctctccgctcacgttcggtgctgggaccaagctggagctgaaa

SEQ ID NO: 325 - protein, 107 aa, Mus musculus
SIVMTQTPKFLLVSAGDRVTITCKASQSVSNDVAWYQQKPGQSPKLLIYCASNRYTGVPDRFTGSGYGTDFTFTISTVQAEDLAVYFCQQDYSSPLTFGAGTKLELK

SEQ ID NO: 326 - DNA, 357 bp, Mus musculus
  misc_feature (1)..(357): SC16.133 VH
  CDS (1)..(357)
caggtgcagctgaaggagtcaggacctggcctggtggcgccctcacagagcctgtccatcacctgcacagtctctggtttctcattaaccaactatgctgtacactgggttcgccagtctccaggaaagggtctggagtggctgggagtgatatggagtgatggaagcacagactataatgcagctttcatatctagactgagcatcagcaaggacaactccaagagccaagttttctttaagatgaacagtctgcaagctgatgacacagccatgtactactgtgcccgaaagaaaggaggatggtttccctggtttgcttactggggccaagggactctggtcactgtctctgca

SEQ ID NO: 327 - protein, 119 aa, Mus musculus
QVQLKESGPGLVAPSQSLSITCTVSGFSLTNYAVHWVRQSPGKGLEWLGVIWSDGSTDYNAAFISRLSISKDNSKSQVFFKMNSLQADDTAMYYCARKKGGWFPWFAYWGQGTLVTVSA

SEQ ID NO: 328 - DNA, 333 bp, Mus musculus
  misc_feature (1)..(333): SC16.134 VL
  CDS (1)..(333)
gacattgtgctgacccaatctccagcttctttggctgtgtctctagggcagagggccaccatctcctgcaaggccagccaaagtgttgatcatgctggtgatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatccgtacacgttcggaggggggaccaagctggaaatcaaa

SEQ ID NO: 329 - protein, 111 aa, Mus musculus
DIVLTQSPASLAVSLGQRATISCKASQSVDHAGDSYMNWYQQKPGQPPKLLIYAASNLESGIPARFSGSGSGTDFTLNIHPVEEEDAATYYCQQSNEDPYTFGGGTKLEIK

SEQ ID NO: 330 - DNA, 351 bp, Mus musculus
  misc_feature (1)..(351): SC16.134 VH
  CDS (1)..(351)
gaggtccagctgcagcagtctggacctgacctggtgaagcctggggcttcagtgaagatatcctgcaaggcttctggttactcattcactggctactacatgcactgggtgaagcagagccatggaaagaggcttgagtggattggacgtgttaatcctaacaatggtggtactaactacaaccagaaattcaagggcaaggccatattaactgtagacaagtcatccagcacagcctacatggagctccgcagcctgacatctgaggactctgcggtctattactgtgcaagagggagttatgataacgccgagggctggggccaagggactctggtcactgtctctgca

SEQ ID NO: 331 - protein, 117 aa, Mus musculus
EVQLQQSGPDLVKPGASVKISCKASGYSFTGYYMHWVKQSHGKRLEWIGRVNPNNGGTNYNQKFKGKAILTVDKSSSTAYMELRSLTSEDSAVYYCARGSYDNAEGWGQGTLVTVSA

SEQ ID NO: 332 - DNA, 321 bp, Mus musculus
  misc_feature (1)..(321): SC16.135 VL
  CDS (1)..(321)
gacatcaagatgacccagtctccatcttccatgtatgcatctctaggagagagagtcactatcacttgcaaggcgagtcaggacattaataggtatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccattcacgttcggctcggggacaaagttggaaataaaa

SEQ ID NO: 333 - protein, 107 aa, Mus musculus
DIKMTQSPSSMYASLGERVTITCKASQDINRYLSWFQQKPGKSPKTLIYRANRLVDGVPSRFSGSGSGQDYSLTISSLEYEDMGIYYCLQYDEFPFTFGSGTKLEIK

SEQ ID NO: 334 - DNA, 363 bp, Mus musculus
  misc_feature (1)..(363): SC16.135 VH
  CDS (1)..(363)
caggtccagttgcagcagtctggagctgagctggtaaggcctgggacttcagtgaaggtgtcctgcaaggcttctggatacgccttcactaattacttgatagagtgggtaaagcagaggcctggacagggccttgagtggattggggtgattaatcctggaagtggtggtactaactccaatgagaagttcaaggccaaggcaacactgactgcagacaaatcctccagcactgcctacatgcagctcagcagcctgacatctgctgactctgcggtctatttctgtgcaagatcggactatgattacgccttctatgctatggactactggggtcaaggaacctcagtcaccgtctcctca

SEQ ID NO: 335 - protein, 121 aa, Mus musculus
QVQLQQSGAELVRPGTSVKVSCKASGYAFTNYLIEWVKQRPGQGLEWIGVINPGSGGTNSNEKFKAKATLTADKSSSTAYMQLSSLTSADSAVYFCARSDYDYAFYAMDYWGQGTSVTVSS

SEQ ID NO: 336 - DNA, 321 bp, Mus musculus
  misc_feature (1)..(321): SC16.136 VL
  CDS (1)..(321)
gacatccagatgactcagtctccagcctccctatctgcatctgtgggagaaactgtcaccatcacatgtcgagcaagtgggaatattcacaattatttagcatggtatcagcagaaacagggaaaatctcctcacctcctggtctataatgcaaaaaccttagcagatggtgtgccatcaaggttcagtggcagtggatcaggaacacaatattctctcaagatcaacagcctgcagcctgaagattttgggagttattactgtcaacatttttggagtactccgtggacgttcggtggaggcaccaagctggaaatcaaa

SEQ ID NO: 337 - protein, 107 aa, Mus musculus
DIQMTQSPASLSASVGETVTITCRASGNIHNYLAWYQQKQGKSPHLLVYNAKTLADGVPSRFSGSGSGTQYSLKINSLQPEDFGSYYCQHFWSTPWTFGGGTKLEIK

SEQ ID NO: 338 - DNA, 366 bp, Mus musculus
  misc_feature (1)..(366): SC16.136 VH
  CDS (1)..(366)
gaggtccagctgcagcagtctggacctgagctggtaaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagacaggtcgggctacgaagattactatggtatggactactggggtcaaggaacctcagtcaccgtctcctca

SEQ ID NO: 339 - protein, 122 aa, Mus musculus
EVQLQQSGPELVKPGASVKMSCKASGYTFTSYVMHWVKQKPGQGLEWIGYINPYNDGTKYNEKFKGKATLTSDKSSSTAYMELSSLTSEDSAVYYCARDRSGYEDYYGMDYWGQGTSVTVSS

SEQ ID NO: 340 - DNA, 318 bp, Mus musculus
  misc_feature (1)..(318): SC16.137 VL
  CDS (1)..(318)
caaattgttctcacccagtctccagcaatcatgtctgcatctctaggggaggagatcaccctaacctgcagtgccagctcgagtgtaagttacatgcactggtaccagcagaagtcaggcacttctcccaaactcttgatttatagcacatccaacctggcttctggagtcccttctcgcttcagtggcagtgggtctgggaccttttattctctcacaatcagcagtgtggaggctgaagatgctgccgattattactgccatcagtggagtagttatcacacgttcggaggggggaccaagctggaaataaaacgg

SEQ ID NO: 341 - protein, 106 aa, Mus musculus
QIVLTQSPAIMSASLGEEITLTCSASSSVSYMHWYQQKSGTSPKLLIYSTSNLASGVPSRFSGSGSGTFYSLTISSVEAEDAADYYCHQWSSYHTFGGGTKLEIKR

SEQ ID NO: 342 - DNA, 351 bp, Mus musculus
  misc_feature (1)..(351): SC16.137 VH
  CDS (1)..(351)
gaggtgcagctggtggagtctgggggagacttagtgaagcctggagggtccctgaaactctcctgtgcagcctctggattcactttcagtagctatggcatgtcttgggttcgccagactccagacaagaggctggagtgggtcgcaaccattagtagtggtggtagttacacctactatccagacagtgtgaaggggcgattcaccatctccagagacaatgccaagaacaccctgtacctgcaaatgagcagtctgaagtctgaggacacagccatgtattactgtgcaagacgaagagccgatgctatggactactggggtcaaggaacctcagtcaccgtctcctca

SEQ ID NO: 343 - protein, 117 aa, Mus musculus
EVQLVESGGDLVKPGGSLKLSCAASGFTFSSYGMSWVRQTPDKRLEWVATISSGGSYTYYPDSVKGRFTISRDNAKNTLYLQMSSLKSEDTAMYYCARRRADAMDYWGQGTSVTVSS

SEQ ID NO: 344 - DNA, 321 bp, Mus musculus
  misc_feature (1)..(321): SC16.138 VL
  CDS (1)..(321)
gacattcagatgacccagtctcctgcctcccagtctgcatctctgggagaaagtgtcaccatcacatgcctggcaagtcagaccattggtacatggttagcatggtatcagcagaaaccagggaaatctcctcagctcctgatttattctgcaaccagcttggcagatggggtcccatcaaggttcagtggtagtggatctggcacaaaattttctttcaagatcagcagcctacaggctgaagattttgtaagttattactgtcaacaactttacagtactccgtggacgttcggtggaggcaccaagctggaaatcaaa

SEQ ID NO: 345 - protein, 107 aa, Mus musculus
DIQMTQSPASQSASLGESVTITCLASQTIGTWLAWYQQKPGKSPQLLIYSATSLADGVPSRFSGSGSGTKFSFKISSLQAEDFVSYYCQQLYSTPWTFGGGTKLEIK

SEQ ID NO: 346 - DNA, 348 bp, Mus musculus
  misc_feature (1)..(348): SC16.138 VH
  CDS (1)..(348)
caggtgcagctgaaggagtcaggacctggcctggtggcgccctcacagagcctgtccatcacatgcactgtctcagggttctcattaaccgactatggtgtaagctggattcgccagcctccaggaaagggtctggagtggctgggagtagtatggggtggtggaagcacatactataattccgctctcaaatccagactgagcatcagcaaggacaactccaagagccaagttttcttaaaaatgaacagtctgcaaactgatgacacagccatgtactactgtgccaaacagaggggtcagtacggggcttactggggccaagggactctggtcactgtctctgca

SEQ ID NO: 347 - protein, 116 aa, Mus musculus
QVQLKESGPGLVAPSQSLSITCTVSGFSLTDYGVSWIRQPPGKGLEWLGVVWGGGSTYYNSALKSRLSISKDNSKSQVFLKMNSLQTDDTAMYYCAKQRGQYGAYWGQGTLVTVSA

SEQ ID NO: 348 - DNA, 321 bp, Mus musculus
  misc_feature (1)..(321): SC16.139 VL
  CDS (1)..(321)
gacattgtgatgacccagtctcacaaattcatgtccacatcagtaggagacagggtcagcatcacctgcaaggccagtcaggatgtgaatactgctgtaggctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtagtccgtacacgttcggaggggggaccaagctggaaattaaa

SEQ ID NO: 349 - protein, 107 aa, Mus musculus
DIVMTQSHKFMSTSVGDRVSITCKASQDVNTAVGWYQQKPGQSPKLLIYSASYRYTGVPDRFTGSGSGTDFTFTISSVQAEDLAVYYCQQHYSSPYTFGGGTKLEIK

SEQ ID NO: 350 - DNA, 357 bp, Mus musculus; identical to SEQ ID NO: 238
  misc_feature (1)..(357): SC16.139 VH
  CDS (1)..(357)

SEQ ID NO: 351 - protein, 119 aa, Mus musculus; identical to SEQ ID NO: 239

SEQ ID NO: 352 - DNA, 333 bp, Mus musculus
  misc_feature (1)..(333): SC16.140 VL
  CDS (1)..(333)
gacattgtgctgacacagtctcttgcttccttagctgtatctctggggcagagggccaccatctcatgcagggccagcaaaagtgtcagtacatctggctatagttatatgcactggtaccaacagaaaccaggacagccacccaaactcctcatttatcttgcatccaacctagaatctggggtccctgccaggttcagtggcagtgggtctgggacagacttcaccctcaacatccatcctgtggaagacgaagatgctgcaacctattactgtcagcacagtagggagcttccgttcacgttcggaggggggaccaagctggaaataaag

SEQ ID NO: 353 - protein, 111 aa, Mus musculus
DIVLTQSLASLAVSLGQRATISCRASKSVSTSGYSYMHWYQQKPGQPPKLLIYLASNLESGVPARFSGSGSGTDFTLNIHPVEDEDAATYYCQHSRELPFTFGGGTKLEIK

SEQ ID NO: 354 - DNA, 348 bp, Mus musculus
  misc_feature (1)..(348): SC16.140 VH
  CDS (1)..(348)
caggtccaactgcagcagtctgggcctgagctggtgaggcctggggcttcagtgaagatgtcctgcaaggcttcaggctataccttcaccagctactggatgcactgggtgaaacagaggcctggacaaggccttgagtggattggcatgattgatccttccaatagtgaaactaggttaaatcagaagttcaaggacaaggccacattgaatgtagacaaatcctccaacacagcctacatgcagctcagcagcctgacatctgaggactctgcagtctattactgtgcagtaatggactactactttgactactggggccaaggcaccactctcacagtctcctca

SEQ ID NO: 355 - protein, 116 aa, Mus musculus
QVQLQQSGPELVRPGASVKMSCKASGYTFTSYWMHWVKQRPGQGLEWIGMIDPSNSETRLNQKFKDKATLNVDKSSNTAYMQLSSLTSEDSAVYYCAVMDYYFDYWGQGTTLTVSS

SEQ ID NO: 356 - DNA, 321 bp, Mus musculus; identical to SEQ ID NO: 232
  misc_feature (1)..(321): SC16.141 VL
  CDS (1)..(321)

SEQ ID NO: 357 - protein, 107 aa, Mus musculus; identical to SEQ ID NO: 233

SEQ ID NO: 358 - DNA, 345 bp, Mus musculus; identical to SEQ ID NO: 234
  misc_feature (1)..(345): SC16.141 VH
  CDS (1)..(345)

SEQ ID NO: 359 - protein, 115 aa, Mus musculus; identical to SEQ ID NO: 235

SEQ ID NO: 360 - DNA, 321 bp, Mus musculus
  misc_feature (1)..(321): SC16.142 VL
  CDS (1)..(321)
gacatcaagatgacccagtctccatcttccatgtatgcatctctaggagagagagtcactatcacttgcaaggcgagtcaggacattaataattatttaagctggttccagcagaaaccagggaaatctcctaagaccctgatctatcgtgcaaacagattggtagatggggtcccatcaaggttcagtggcagtggatctgggcaagattattctctcaccatcagcagcctggagtatgaagatatgggaatttattattgtctacagtatgatgagtttccgtacacgttcggaggggggaccaagctggaaataaaa

SEQ ID NO: 361 - protein, 107 aa, Mus musculus
DIKMTQSPSSMYASLGERVTITCKASQDINNYLSWFQQKPGKSPKTLIYRANRLVDGVPSRFSGSGSGQDYSLTISSLEYEDMGIYYCLQYDEFPYTFGGGTKLEIK

SEQ ID NO: 362 - DNA, 345 bp, Mus musculus
  misc_feature (1)..(345): SC16.142 VH
  CDS (1)..(345)
gaggtccagcttcagcagtcaggacctgagctggtgaaacctggggcctcagtgaagatatcctgcaaggcttctggatacacattcactgactacaacatgcactgggtgaagcagagccatggaaagagccttgagtggattggattcttttatccttacaacggtaatactgtctacagccagaagttcaagagcaaggccacattgactgtagacaattcctccagcacagcctacatggagctccgcagcctgacatctgaggactctgcagtctattactgtgcaagacttaactgggagggctactggggccaaggcaccaccctcacvgtntcntcn

SEQ ID NO: 363 - protein, 115 aa, Mus musculus
  misc_feature (112)..(112): The 'Xaa' at location 112 stands for Thr.
  misc_feature (114)..(114): The 'Xaa' at location 114 stands for Ser.
  misc_feature (115)..(115): The 'Xaa' at location 115 stands for Ser.
EVQLQQSGPELVKPGASVKISCKASGYTFTDYNMHWVKQSHGKSLEWIGFFYPYNGNTVYSQKFKSKATLTVDNSSSTAYMELRSLTSEDSAVYYCARLNWEGYWGQGTTLXVXX

SEQ ID NO: 364 - DNA, 336 bp, Mus musculus
  misc_feature (1)..(336): SC16.143 VL
  CDS (1)..(336)
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttccgctcacgttcggtgctgggaccaagctggagctgaaa

SEQ ID NO: 365 - protein, 112 aa, Mus musculus
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPLTFGAGTKLELK

SEQ ID NO: 366 - DNA, 357 bp, Mus musculus
  misc_feature (1)..(357): SC16.143 VH
  CDS (1)..(357)
caggtccagctgcagcagtctggacctgagctggtgaagcctggggcttcagtgaggatatcctgcaaggcttctggctacaccttcacaagctactatatacactgggtgaagcagaggcctggacagggacttgagtggattggatggatttatcctggaaatggtaatactaagtacaatgagaagttcaagggcaaggccacactgactgcagacaaatcctccagcacagcctacatgcagatcagcagcctgacctctgaggactctgcggtctatttctgtgcaagagagagatggttactactatggtttgcttactggggccaagggactctggtcactgtctctgca

SEQ ID NO: 367 - protein, 119 aa, Mus musculus
QVQLQQSGPELVKPGASVRISCKASGYTFTSYYIHWVKQRPGQGLEWIGWIYPGNGNTKYNEKFKGKATLTADKSSSTAYMQISSLTSEDSAVYFCARERWLLLWFAYWGQGTLVTVSA

SEQ ID NO: 368 - DNA, 321 bp, Mus musculus
  misc_feature (1)..(321): SC16.144 VL
  CDS (1)..(321)
agtattgtgatgacccagactcccaaattcctgcttgtatcagcaggagacagggttaccataacctgcaaggccagtcagagtgtgagtaatgatgtaggttggtaccaacagaagccagggcagtctcctaaactgctgatatactatgcatccaatcgctacaatggagtccctgatcgcttcactggcagtggatatgggacggatttcactttcaccatcagcactgtgcaggctgaagacctggcagtttatttctgtcagcaggattatagctctccgtggacgttcggtggaggcaccaagctggaaatcaaa

SEQ ID NO: 369 - protein, 107 aa, Mus musculus
SIVMTQTPKFLLVSAGDRVTITCKASQSVSNDVGWYQQKPGQSPKLLIYYASNRYNGVPDRFTGSGYGTDFTFTISTVQAEDLAVYFCQQDYSSPWTFGGGTKLEIK

SEQ ID NO: 370 - DNA, 354 bp, Mus musculus
  misc_feature (1)..(354): SC16.144 VH
  CDS (1)..(354)
cagatccagttggtgcagtctggacctgagctgaagaagcctggagagacagtcaagatctcctgcaaggcttctgggtataccttcacaaactatggaatgaactgggtgaagcaggctccaggaaagggtttaaagtgggtgggctggataaacacctacactggagagccaacatatgctgatgacttcaagggacggtttgccttctctttggaaacctctgccagcactgcctatttgcagatcgacaacctcaaaaatgaggacacggctacatatttctgtgcaagagtgggggattacgtcggctttgactactggggccaaggcaccactctcacagtctcctca

SEQ ID NO: 371 - protein, 118 aa, Mus musculus
QIQLVQSGPELKKPGETVKISCKASGYTFTNYGMNWVKQAPGKGLKWVGWINTYTGEPTYADDFKGRFAFSLETSASTAYLQIDNLKNEDTATYFCARVGDYVGFDYWGQGTTLTVSS

SEQ ID NO: 372 - DNA, 321 bp, Mus musculus
  misc_feature (1)..(321): SC16.147 VL
  CDS (1)..(321)
gatatccagatgacacagactgcatcctccctgtctgcctctctgggagacagagtcaccatcagttgcagggcaagtcaggacattaacaattatttaaactggtatcagcagaaaccagatggaactgttaaactcctgatctactacacatcaagattacactcaggagtcccatcaaggttcagtggcagtgggtctggaacagattattctctcaccattagcatcctggaacaagaagatattgccacttacttttgccaacagggtgatacgcttccgtggacgttcggtggaggcaccaagctggaaatcaaa

SEQ ID NO: 373 - protein, 107 aa, Mus musculus
DIQMTQTASSLSASLGDRVTISCRASQDINNYLNWYQQKPDGTVKLLIYYTSRLHSGVPSRFSGSGSGTDYSLTISILEQEDIATYFCQQGDTLPWTFGGGTKLEIK

SEQ ID NO: 374 - DNA, 351 bp, Mus musculus
  misc_feature (1)..(351): SC16.147 VH
  CDS (1)..(351)
cagatccagttggtgcagtctggacctgagctgacgaagcctggagagacagtcaagatctcctgcaaggcctctggatataccttcacagactattcattgcactgggtgaagcaggctctaggaaagggtttaaagtggatgggctggataaacactgagactggtgagccagcatatgcagatgacttcaagggacggtttgccttctctttggaaacctctgccagcactgcctatttgcagatcaacgacctcaaaaatgaggacacgactacatatttctgtggtatttacgacgggtatgctatggactactggggtcaaggaacctcagtcaccgtctcctca

SEQ ID NO: 375 - protein, 117 aa, Mus musculus
QIQLVQSGPELTKPGETVKISCKASGYTFTDYSLHWVKQALGKGLKWMGWINTETGEPAYADDFKGRFAFSLETSASTAYLQINDLKNEDTTTYFCGIYDGYAMDYWGQGTSVTVSS

SEQ ID NO: 376 - DNA, 318 bp, Mus musculus
  misc_feature (1)..(318): SC16.148 VL
  CDS (1)..(318)
caaattgttctcacccagtctccagcaatcatgtctgcatctccaggggagaaggtcaccatgacctgcagtgccagctcaagtgtaagttacatgtactggtaccagcagaagccaggatcctcccccagactcctgatttatgacacatccaacctggcttctggagtccctgttcgcttcagtggcagtgggtctgggacctcttactctctcacaatcagccgaatggaggctgaagatactgccacttattattgccaggagtggagtaataatccgctcacgttcggtgatgggaccaagctggagctgaaa

SEQ ID NO: 377 - protein, 106 aa, Mus musculus
QIVLTQSPAIMSASPGEKVTMTCSASSSVSYMYWYQQKPGSSPRLLIYDTSNLASGVPVRFSGSGSGTSYSLTISRMEAEDTATYYCQEWSNNPLTFGDGTKLELK

SEQ ID NO: 378 - DNA, 354 bp, Mus musculus
  misc_feature (1)..(354): SC16.148 VH
  CDS (1)..(354)
cagatccagttggtgcagtctggacctgagctgaagaagcctggagagacagtcaagatctcctgcaaggcttctgggtataccctcacaaactatggaatgaactgggtgaagcaggctccaggaaagggtttaaagtggatgggctggataaacacctacactggagagccaacatatgctgatgacttcaagggacggtttgccttctctttggaaacctctgccaggattgtctatttgcagatcaacaacctcaaaaatgaggacacggctacatatttctgtgcaaaatatgaggcccacgaggggtttgtttattggggccaagggactctggtcactgtctctgca

SEQ ID NO: 379 - protein, 118 aa, Mus musculus
QIQLVQSGPELKKPGETVKISCKASGYTLTNYGMNWVKQAPGKGLKWMGWINTYTGEPTYADDFKGRFAFSLETSARIVYLQINNLKNEDTATYFCAKYEAHEGFVYWGQGTLVTVSA

SEQ ID NO: 380 - DNA, 321 bp, Mus musculus
  misc_feature (1)..(321): SC16.149 VL
  CDS (1)..(321)
gacatccagatgaaccagtctccatccagtctgtctgcatcccttggagacacaattaccatcacttgccatgccagtcagaacattaatgtttggttaagctggtaccagcagaaaccaggaaatattccaaaactattgatctataaggcttcccacttgcacacaggcgtcccatcaaggttgagtggcagtggatctggaacaggtttcacattaaccatcagcagcctgcagcctgaagacattgccacttactactgtcaacagggtcaaagttatccattcacgttcggctcggggacaacgttggaaataaaa

SEQ ID NO: 381 - protein, 107 aa, Mus musculus
DIQMNQSPSSLSASLGDTITITCHASQNINVWLSWYQQKPGNIPKLLIYKASHLHTGVPSRLSGSGSGTGFTLTISSLQPEDIATYYCQQGQSYPFTFGSGTTLEIK

SEQ ID NO: 382 - DNA, 348 bp, Mus musculus
  misc_feature (1)..(348): SC16.149 VH
  CDS (1)..(348)
caggtgcagctgaaggagtcaggacctggcctggtggcgccctcacagagcctgtccatcacttgcgctgtctctgggttttcattaaccagctttggtgtacactgggttcgccagcctccaggaaagggtctggagtggctgggagttatatgggctggtggaagcacaaattattattcggctctcatgtccagactgagcatcagcatagacaactccaagagccaagttttcttaaagatgaacagtctgcaaactgatgacacagccatgtactactgtgccagagactgggagggctggtttgcttactggggccaagggactctggtcactgtctctgca

SEQ ID NO: 383 - protein, 116 aa, Mus musculus
QVQLKESGPGLVAPSQSLSITCAVSGFSLTSFGVHWVRQPPGKGLEWLGVIWAGGSTNYYSALMSRLSISIDNSKSQVFLKMNSLQTDDTAMYYCARDWEGWFAYWGQGTLVTVSA

SEQ ID NO: 384 - DNA, 339 bp, Mus musculus
  misc_feature (1)..(339): SC16.150 VL
  CDS (1)..(339)
gacattgtgatgtcacagtctccatcctccctaactgtgtcagttggagagaaggttactatgagctgcatgtccagtcagagccttttatatagtagcactcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatccgtacacgttcggaggggggaccaagctggaaataaaa

SEQ ID NO: 385 - protein, 113 aa, Mus musculus
DIVMSQSPSSLTVSVGEKVTMSCMSSQSLLYSSTQKNYLAWYQQKPGQSPKLLIYWASTRESGVPDRFTGSGSGTDFTLTISSVKAEDLAVYYCQQYYSYPYTFGGGTKLEIK

SEQ ID NO: 386 - DNA, 351 bp, Mus musculus
  misc_feature (1)..(351): SC16.150 VH
  CDS (1)..(351)
gagatccagctgcagcagtctggacctgagctggtgaagcctggggcttcagtgaaggtatcctgcaaggcttctggttatgcattcactagctacaacatgtactgggtgagtcagagccatggaaagagccttgagtggattggatatattgatccttacaatggtggcactagctacaaccagaagttcaggggcaaggccacattgactgttgacaagtcctcaagcacagcctacatgcatctcaacagcctgacatctgaggactcggcagtctattattgtgcaagagagaactataggtactttgacttctggggccaaggcaccactctcacagtctcctca

SEQ ID NO: 387 - protein, 117 aa, Mus musculus
EIQLQQSGPELVKPGASVKVSCKASGYAFTSYNMYWVSQSHGKSLEWIGYIDPYNGGTSYNQKFRGKATLTVDKSSSTAYMHLNSLTSEDSAVYYCARENYRYFDFWGQGTTLTVSS

SEQ ID NO: 388 - DNA, 318 bp, Artificial Sequence
  Humanized antibody sequence
  misc_feature (1)..(318): HSC16.13 VL
  CDS (1)..(318)
gacatccagatgacccagtctccatcctccctgtctgcatctgtaggagacagagtcaccatcacttgcagtgcaagtagcagcgttagctatatgtattggtatcagcagaaaccagggaaagcccctaagctcctgatctacctcactagtaacttggcaagtggggtcccatcaaggttcagtggcagtggatctgggacagatttcactctcaccatcagcagtctgcaacctgaagattttgcaacttactactgtcaacagtggcgtagtaacccattcacgttcggccaggggacaaagttggaaataaaa

SEQ ID NO: 389 - protein, 106 aa, Artificial Sequence
  Synthetic Construct
DIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIK

SEQ ID NO: 390 - DNA, 372 bp, Artificial Sequence
  Humanized antibody sequence
  misc_feature (1)..(372): HSC16.13 VH
  CDS (1)..(372)
cagatcaccttgaaggagtctggtcctacgctggtgaaacccacacagaccctcacgctgacctgcaccttctctgggttctcactcagcactagtggaatgggtgtgggctggatccgtcagcccccaggaaaggccctggagtggcttgcacacatttggtgggatgatgttaagcgctacagcccatctctgaagagcaggctcaccatcaccaaggacacctccaaaaaccaggtggtccttacaatgaccaacatggaccctgtggacacagccacatattactgtgcacgcatagtttcctttgataacgacgttgtctctgctatggactactggggtcaaggaaccctagtcaccgtctcctcc

SEQ ID NO: 391 - protein, 124 aa, Artificial Sequence
  Synthetic Construct
QITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSS

SEQ ID NO: 392 - DNA, 321 bp, Artificial Sequence
  Humanized antibody sequence
  misc_feature (1)..(321): HSC16.15 VL
  CDS (1)..(321)
gccatccagttgacccagtctccatcctccctgtctgcatctgtaggagacagagtcaccatcacttgccgggcaagtgagaacatttattataatttagcctggtatcagcagaaaccagggaaagctcctaagctcctgatctatactgccaatagtttggaagatggggtcccatcaaggttcagcggcagtggatctgggacagatttcactctcaccatcagcagcctgcagcctgaagattttgcaacttatttttgtaaacaggcttatgacgttcctccgacgttcggtggaggcaccaagctggaaatcaaa

SEQ ID NO: 393 - protein, 107 aa, Artificial Sequence
  Synthetic Construct
AIQLTQSPSSLSASVGDRVTITCRASENIYYNLAWYQQKPGKAPKLLIYTANSLEDGVPSRFSGSGSGTDFTLTISSLQPEDFATYFCKQAYDVPPTFGGGTKLEIK

SEQ ID NO: 394 - DNA, 351 bp, Artificial Sequence
  Humanized antibody sequence
  misc_feature (1)..(351): HSC16.15 VH
  CDS (1)..(351)
caggtgcagctggtgcagtctggggctgaggtgaagaagcctggggcctcagtgaaggtttcctgcaaggcatctggatacaccttcaccaggtactggatacactggatacgacaggcccctggacaagggcttgagtggatgggatacatcaaccctacaactgtttatactgagttcaatcagaacttcaaggacagagtcaccatgaccagggacacgtccacgagcacagtctacatggagctgagcagcctgagatctgaggacacggccgtgtattactgtgcgagaggcggtagtaacttctttgactactggggccaaggcaccactgtcacagtctcctca

SEQ ID NO: 395 - protein, 117 aa, Artificial Sequence
  Synthetic Construct
QVQLVQSGAEVKKPGASVKVSCKASGYTFTRYWIHWIRQAPGQGLEWMGYINPTTVYTEFNQNFKDRVTMTRDTSTSTVYMELSSLRSEDTAVYYCARGGSNFFDYWGQGTTVTVSS

SEQ ID NO: 396 - DNA, 318 bp, Artificial Sequence
  Humanized antibody sequence
  misc_feature (1)..(318): HSC16.25 VL
  CDS (1)..(318)
gaaattgtgctgactcagtctccagactttcagtctgtgactccaaaggagaaagtcaccatcacctgcagtgccagtagcagtgtgagctacatgcactggtaccagcagaaaccagatcagtctccaaagctcctcatcaaggatagttccaaactcgcctcaggggtcccctcgaggttcagtggcagtggatctgggacagatttcaccctcaccatcaatagcctggaagctgaagatgctgcaacgtattactgtcagcagtggagtagtaacccgctcacgttcggtcaggggaccaagctggagatcaaa

SEQ ID NO: 397 - protein, 106 aa, Artificial Sequence
  Synthetic Construct
EIVLTQSPDFQSVTPKEKVTITCSASSSVSYMHWYQQKPDQSPKLLIKDSSKLASGVPSRFSGSGSGTDFTLTINSLEAEDAATYYCQQWSSNPLTFGQGTKLEIK

SEQ ID NO: 398 - DNA, 372 bp, Artificial Sequence
  Humanized antibody sequence
  misc_feature (1)..(372): HSC16.25 VH
  CDS (1)..(372)
cagatcaccttgaaggagtctggtcctacgctggtgaaacccacacagaccctcacgctgacctgcaccttctctgggttctcactcagcactagtggaatgggtgtgggctggatccgtcagcccccaggaaaggccctggagtggcttacagacatttggtgggatgataataagtactacaacccatctctgaagagcaggctcaccatcaccaaggacacctccaaaaaccaggtggtccttacaatgaccaacatggaccctgtggacacagccacatattactgtgcacgaagagttaactattattacgacccgtactatgctatggactactggggtcaaggaaccctagtcaccgtctcctca

SEQ ID NO: 399 - protein, 124 aa, Artificial Sequence
  Synthetic Construct
QITLKESGPTLVKPTQTLTLTCTFSGFSLSTSGMGVGWIRQPPGKALEWLTDIWWDDNKYYNPSLKSRLTITKDTSKNQVVLTMTNMDPVDTATYYCARRVNYYYDPYYAMDYWGQGTLVTVSS

SEQ ID NO: 400 - DNA, 321 bp, Artificial Sequence
  Humanized antibody sequence
  misc_feature (1)..(321): HSC16.34 VL
  CDS (1)..(321)
gacatccagatgacccagtctccatcctccctgtctgcatctgtaggagacagagtcaccatcacttgcaaggcgagtcagagcgttagcaatgatgtagcctggtatcagcagaaaccagggaaagttcctaagctcctgatctattatgcatccaataggtactcaggggtcccatctcggttcagtggcagtggatctgggacagatttcactctcaccatcagcagcctgcagcctgaagatgttgcaacttatttctgtcagcaggattatagctctccgtggacgttcggtggaggcaccaaggtggaaatcaaa

SEQ ID NO: 401 - protein, 107 aa, Artificial Sequence
  Synthetic Construct
DIQMTQSPSSLSASVGDRVTITCKASQSVSNDVAWYQQKPGKVPKLLIYYASNRYSGVPSRFSGSGSGTDFTLTISSLQPEDVATYFCQQDYSSPWTFGGGTKVEIK

SEQ ID NO: 402 - DNA, 354 bp, Artificial Sequence
  Humanized antibody sequence
  misc_feature (1)..(354): HSC16.34 VH
  CDS (1)..(354)
caggtccagcttgtgcagtctggggctgaggtgaagaagcctggggcctcagtgaaggtttcctgcaaggcttctggatacaccttcactaactatggtatgaattgggtgcgccaggcccccggacaaaggcttgagtggatgggatggatcaacacttacactggtgacccaacatatgcagatgatttcaagggcagagtcaccattaccagggacacatccgcgagcacagcctacatggagctgagcagcctgagatctgaagacacggctgtgtattactgtgcgagaattggcggtaatagtccctctgattactggggccaaggcaccactgtcacagtctcctca

SEQ ID NO: 403 - protein, 118 aa, Artificial Sequence
  Synthetic Construct
QVQLVQSGAEVKKPGASVKVSCKASGYTFTNYGMNWVRQAPGQRLEWMGWINTYTGDPTYADDFKGRVTITRDTSASTAYMELSSLRSEDTAVYYCARIGGNSPSDYWGQGTTVTVSS

SEQ ID NO: 404 - DNA, 321 bp, Artificial Sequence
  Humanized antibody sequence
  misc_feature (1)..(321): HSC16.56 VL
  CDS (1)..(321)
gagatcgtgatgacccagtcccctgccacactgtccgtgtcccctggagagagggccaccctgtcctgcaaggcctcccagtccgtgtccaacgacgtggtgtggtaccagcagaagcccggacaggctcccaggctgctgatctactacgcctccaacaggtacaccggcatccctgccaggttctccggatccggatccggcaccgagttcaccctgaccatctcctccctgcagtccgaggacttcgccgtgtactactgccagcaggactacacctccccctggacctttggccagggcaccaagctggagatcaag

SEQ ID NO: 405 - protein, 107 aa, Artificial Sequence
  Synthetic Construct
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIK

SEQ ID NO: 406 - DNA, 354 bp, Artificial Sequence
  Humanized antibody sequence
  misc_feature (1)..(354): HSC16.56 VH
  CDS (1)..(354)
caggtgcagctggtgcagtccggcgccgaagtgaagaaacccggcgcctccgtgaaggtgtcctgcaaggcctccggctacaccttcaccaactacggcatgaactgggtgaggcaggctcctggacagggactggagtggatgggctggatcaacacctacaccggcgaacccacctacgccgacgacttcaagggcagggtgaccatgaccaccgacacctccacctccaccgcctacatggagctgaggtccctgaggtccgacgacaccgccgtgtactactgcgctaggattggcgactcctccccctccgattactggggacagggcaccctcgtgaccgtctcctcc

SEQ ID NO: 407 - protein, 118 aa, Artificial Sequence
  Synthetic Construct
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSS

SEQ ID NO: 408 - protein, 10 aa, Artificial Sequence
  HSC16.13 CDRL1
SASSSVSYMY

SEQ ID NO: 409 - protein, 7 aa, Artificial Sequence
  HSC16.13 CDRL2
LTSNLAS

SEQ ID NO: 410 - protein, 9 aa, Artificial Sequence
  HSC16.13 CDRL3
QQWRSNPFT

SEQ ID NO: 411 - protein, 11 aa, Artificial Sequence
  HSC16.15 CDRL1
RASENIYYNLA

SEQ ID NO: 412 - protein, 7 aa, Artificial Sequence
  HSC16.15 CDRL2
TANSLED

SEQ ID NO: 413 - protein, 9 aa, Artificial Sequence
  HSC16.15 CDRL3
KQAYDVPPT

SEQ ID NO: 414 - protein, 10 aa, Artificial Sequence
  HSC16.25 CDRL1
SASSSVSYMH

SEQ ID NO: 415 - protein, 7 aa, Artificial Sequence
  HSC16.25 CDRL2
DSSKLAS

SEQ ID NO: 416 - protein, 9 aa, Artificial Sequence
  HSC16.25 CDRL3
QQWSSNPLT

SEQ ID NO: 417 - protein, 11 aa, Artificial Sequence
  HSC16.34 CDRL1
KASQSVSNDVA

SEQ ID NO: 418 - protein, 7 aa, Artificial Sequence
  HSC16.34 CDRL2
YASNRYS

SEQ ID NO: 419 - protein, 9 aa, Artificial Sequence
  HSC16.34 CDRL3
QQDYSSPWT

SEQ ID NO: 420 - protein, 11 aa, Artificial Sequence
  HSC16.56 CDRL1
KASQSVSNDVV

SEQ ID NO: 421 - protein, 7 aa, Artificial Sequence
  HSC16.56 CDRL2
YASNRYT

SEQ ID NO: 422 - protein, 9 aa, Artificial Sequence
  HSC16.56 CDRL3
QQDYTSPWT

SEQ ID NO: 423 - protein, 7 aa, Artificial Sequence
  HSC16.13 CDRH1
TSGMGVG

SEQ ID NO: 424 - protein, 16 aa, Artificial Sequence
  HSC16.13 CDRH2
HIWWDDVKRYSPSLKS

SEQ ID NO: 425 - protein, 14 aa, Artificial Sequence
  HSC16.13 CDRH3
IVSFDNDVVSAMDY

SEQ ID NO: 426 - protein, 5 aa, Artificial Sequence
  HSC16.15 CDRH1
RYWIH

SEQ ID NO: 427 - protein, 17 aa, Artificial Sequence
  HSC16.15 CDRH2
YINPTTVYTEFNQNFKD

SEQ ID NO: 428 - protein, 8 aa, Artificial Sequence
  HSC16.15 CDRH3
GGSNFFDY

SEQ ID NO: 429 - protein, 7 aa, Artificial Sequence
  HSC16.25 CDRH1
TSGMGVG

SEQ ID NO: 430 - protein, 16 aa, Artificial Sequence
  HSC16.25 CDRH2
DIWWDDNKYYNPSLKS

SEQ ID NO: 431 - protein, 14 aa, Artificial Sequence
  HSC16.25 CDRH3
RVNYYYDPYYAMDY

SEQ ID NO: 432 - protein, 5 aa, Artificial Sequence
  HSC16.34 CDRH1
NYGMN

SEQ ID NO: 433 - protein, 17 aa, Artificial Sequence
  HSC16.34 CDRH2
WINTYTGDPTYADDFKG

SEQ ID NO: 434 - protein, 9 aa, Artificial Sequence
  HSC16.34 CDRH3
IGGNSPSDY

SEQ ID NO: 435 - protein, 5 aa, Artificial Sequence
  HSC16.56 CDRH1
NYGMN

SEQ ID NO: 436 - protein, 17 aa, Artificial Sequence
  HSC16.56 CDRH2
WINTYTGEPTYADDFKG

SEQ ID NO: 437 - protein, 9 aa, Artificial Sequence
  HSC16.56 CDRH3
IGDSSPSDY

The invention claimed is:

1. An antibody drug conjugate (ADC) comprising an anti-DLL3 antibody covalently linked through a linker to one or more pyrrolobenzodiazepines (PBDs), wherein the one or more PBDs is/are

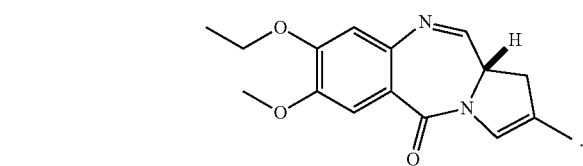

2. The antibody drug conjugate of claim 1, wherein the linker comprises a cleavable linker.

3. The antibody drug conjugate of claim 2, wherein the cleavable linker comprises a peptidyl linker comprising at least two amino acids.

4. The antibody drug conjugate of claim 3, wherein the peptidyl linker comprises a valine-alanine dipeptide.

5. The antibody drug conjugate of claim 4 comprising the structure:

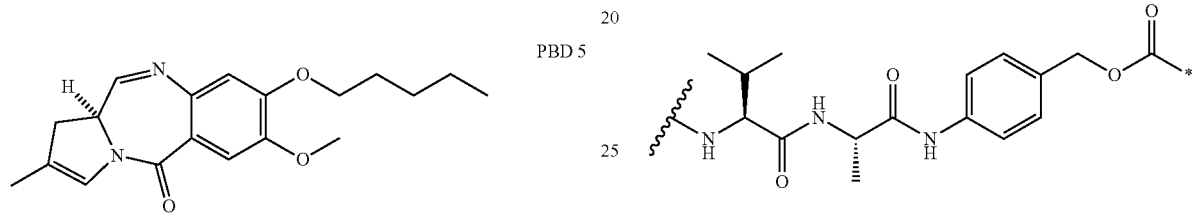

wherein the asterisk indicates the point of attachment to the one or more PBDs, and wherein the wavy line indicates the point of attachment to the remaining portion of the linker.

6. The antibody drug conjugate of claim 5, wherein the linker further comprises a maleimide group.

7. The antibody drug conjugate of claim 1, wherein the anti-DLL3 antibody is covalently linked to more than one PBD.

8. The antibody drug conjugate of claim 1, wherein the ADC has a drug loading of 2.

9. The antibody drug conjugate of claim 1, wherein 1 to 8 PBDs are covalently attached to the anti-DLL3 antibody.

10. The antibody drug conjugate according to claim 1, wherein the antibody drug conjugate comprises

ADC 5

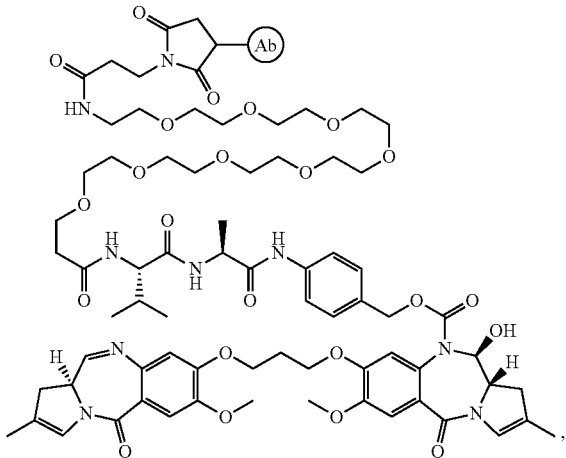

-continued

ADC 4

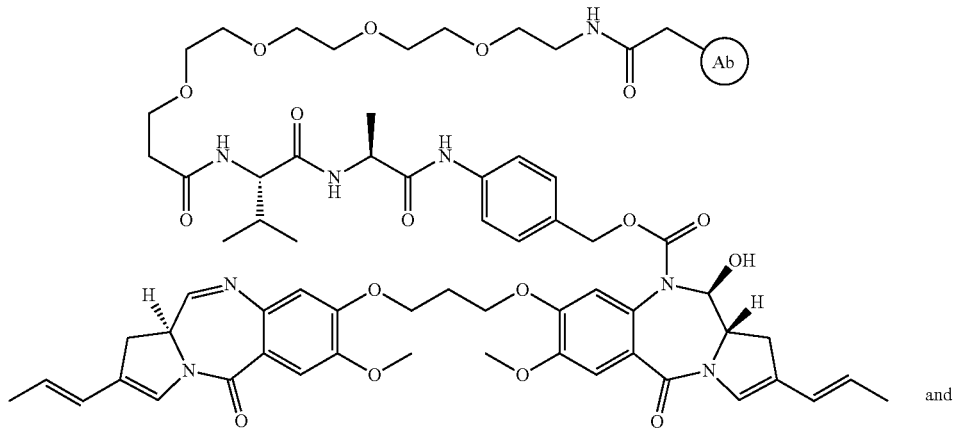

wherein Ab comprises the anti-DLL3 antibody.

11. The antibody drug conjugate according to claim 10, wherein Ab is covalently linked to more than one PBD.

12. The antibody drug conjugate according to claim 10, wherein the ADC has a drug loading of 2.

13. The antibody drug conjugate according to claim 10, wherein 1 to 8 PBDs are covalently attached to Ab.

14. The antibody drug conjugate of claim 1, wherein the anti-DLL3 antibody is selected from the group consisting of monoclonal antibody, chimeric antibody, CDR-grafted antibody, humanized antibody, human antibody, primatized antibody, multispecific antibody, bispecific antibody, monovalent antibody, multivalent antibody, diabody, Fab fragment, F(ab')$_2$ fragment, Fv fragment, and ScFv fragment; or an immunoreactive fragment thereof.

15. The antibody drug conjugate of claim 1, wherein the anti-DLL3 antibody is an internalizing antibody.

16. The antibody drug conjugate of claim 1, wherein the anti-DLL3 antibody specifically binds to an epitope within the DSL domain of a DLL3 protein set forth as SEQ ID NO: 1 or 2.

17. The antibody drug conjugate of claim 16, wherein the anti-DLL3 antibody specifically binds to an epitope comprising amino acids G203, R205, and P206 (SEQ ID NO:4).

18. The antibody drug conjugate of claim 1, wherein the anti-DLL3 antibody competes for binding to a human DLL3 protein with an antibody comprising a light chain variable region set forth as SEQ ID NO: 405 and a heavy chain variable region set forth as SEQ ID NO: 407.

19. The antibody drug conjugate of claim 18, wherein the anti-DLL3 antibody comprises three CDRs of a light chain variable region set forth as SEQ ID NO: 405 and three CDRs of a heavy chain variable region set forth as SEQ ID NO: 407.

20. The antibody drug conjugate of claim 19, wherein the anti-DLL3 antibody comprises residues 24-34 of SEQ ID NO: 405 for CDR-L1, residues 50-56 of SEQ ID NO: 405 for CDR-L2, residues 89-97 of SEQ ID NO: 405 for CDR-L3, residues 31-35 of SEQ ID NO: 407 for CDR-H1, residues 50-65 of SEQ ID NO: 407 for CDR-H2, and residues 95-102 of SEQ ID NO: 407 for CDR-H3, wherein the residues are numbered according to Kabat.

21. The antibody drug conjugate of claim 18, wherein the anti-DLL3 antibody comprises a light chain variable region comprising an amino acid sequence set forth as SEQ ID NO: 405 and a heavy chain variable region comprising an amino acid sequence set forth as SEQ ID NO: 407.

22. A pharmaceutical composition comprising (a) the antibody drug conjugate of claim 1, and (b) a pharmaceutically acceptable carrier.

23. The pharmaceutical composition of claim 22 comprising a drug to antibody ratio (DAR) of 1, 2, 3, 4, 5, 6, 7 or 8 each +/−0.4.

24. The pharmaceutical composition of claim 23 comprising a DAR of 2+/−0.4.

25. The pharmaceutical composition of claim 24 comprising less than 30% of non-predominant ADC species.

26. An antibody drug conjugate (ADC) comprising an anti-DLL3 antibody covalently linked through a linker to one or more pyrrolobenzodiazepines (PBDs),
wherein the anti-DLL3 antibody comprises three CDRs of a light chain variable region set forth as SEQ ID NO: 405 and three CDRs of a heavy chain variable region set forth as SEQ ID NO: 407; and
wherein the one or more PBDs is/are:

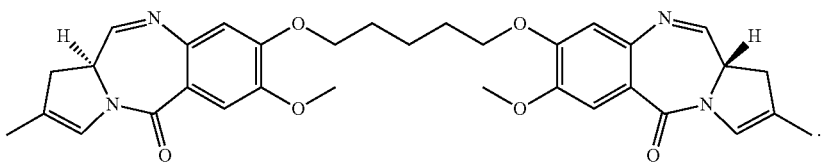

27. The antibody drug conjugate of claim 26, wherein the anti-DLL3 antibody comprises residues 24-34 of SEQ ID NO: 405 for CDR-L1, residues 50-56 of SEQ ID NO: 405 for CDR-L2, residues 89-97 of SEQ ID NO: 405 for CDR-L3, residues 31-35 of SEQ ID NO: 407 for CDR-H1, residues 50-65 of SEQ ID NO: 407 for CDR-H2, and residues 95-102 of SEQ ID NO: 407 for CDR-H3, wherein the residues are numbered according to Kabat.

28. The antibody drug conjugate of claim 27, wherein the anti-DLL3 antibody comprises a light chain variable region comprising an amino acid sequence set forth as SEQ ID NO: 405 and a heavy chain variable region comprising an amino acid sequence set forth as SEQ ID NO: 407.

29. The antibody drug conjugate of claim 28, wherein the linker comprises a valine-alanine dipeptide.

30. The antibody drug conjugate of claim 29 comprising the structure:

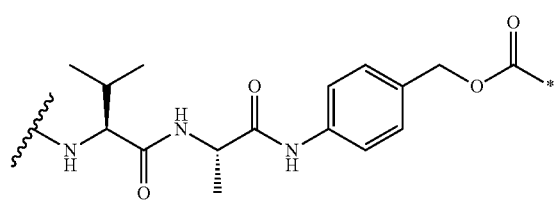 [SMILES: *N[C@H](C(=O)N[C@@H](C)C(=O)Nc1ccc(COC(*)=O)cc1)C(C)C]

wherein the asterisk indicates the point of attachment to the one or more PBDs, and wherein the wavy line indicates the point of attachment to the remaining portion of the linker.

31. The antibody drug conjugate of claim 26, wherein the anti-DLL3 antibody is covalently linked to more than one PBD.

32. The antibody drug conjugate of claim 26, wherein the ADC has a drug loading of 2.

33. The antibody drug conjugate of claim 26, wherein 1 to 8 PBDs are covalently attached to the anti-DLL3 antibody.

34. A pharmaceutical composition comprising (a) the antibody drug conjugate of claim 26, and (b) a pharmaceutically acceptable carrier.

35. The pharmaceutical composition of claim 34 comprising a drug to antibody ratio (DAR) of 1, 2, 3, 4, 5, 6, 7 or 8 each +/−0.4.

36. The pharmaceutical composition of claim 35 comprising a DAR of 2+/−0.4.

37. The pharmaceutical composition of claim 36 comprising less than 30% of non-predominant ADC species.

38. An antibody drug conjugate (ADC) comprising an anti-DLL3 antibody covalently linked through a linker to one or more pyrrolobenzodiazepines (PBDs), wherein the anti-DLL3 antibody comprises a light chain variable region comprising an amino acid sequence set forth as SEQ ID NO: 405 and a heavy chain variable region comprising an amino acid sequence set forth as SEQ ID NO: 407;

wherein the one or more PBDs is/are:

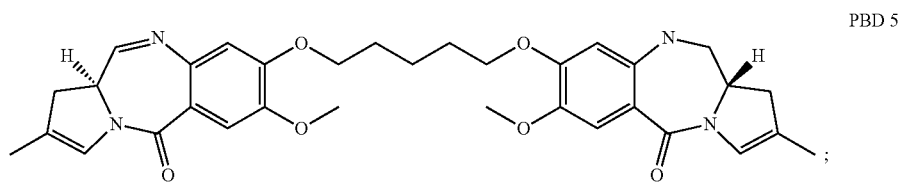

PBD 5 and wherein the ADC has a drug loading of 2.

39. The antibody drug conjugate of claim 38, wherein the linker comprises a valine-alanine dipeptide.

40. The antibody drug conjugate of claim 39 comprising the structure:

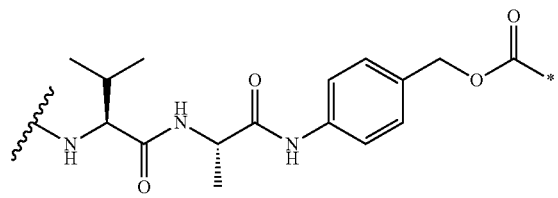 [SMILES: *N[C@H](C(=O)N[C@@H](C)C(=O)Nc1ccc(COC(*)=O)cc1)C(C)C]

wherein the asterisk indicates the point of attachment to the one or more PBDs, and wherein the wavy line indicates the point of attachment to the remaining portion of the linker.

41. A pharmaceutical composition comprising (a) the antibody drug conjugate of claim 40, and (b) a pharmaceutically acceptable carrier.

42. The pharmaceutical composition of claim 41 comprising a DAR of 2+/−0.4.

43. The pharmaceutical composition of claim 42 comprising less than 30% of non-predominant ADC species.

44. An antibody drug conjugate (ADC) comprising:

ADC 5

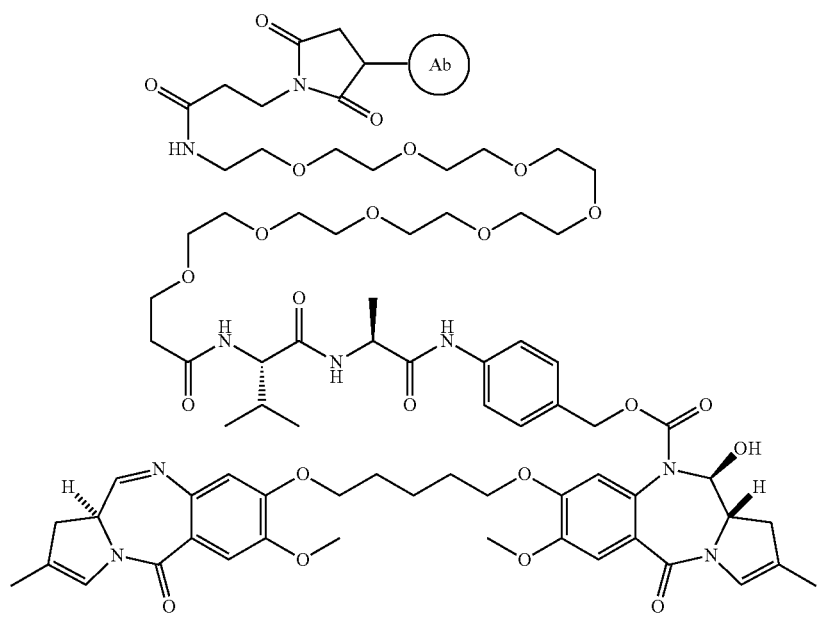

wherein Ab comprises an anti-DLL3 antibody, comprising three CDRs of a light chain variable region set forth as SEQ ID NO: 405 and three CDRs of a heavy chain variable region set forth as SEQ ID NO: 407.

45. The antibody drug conjugate of claim 44, wherein the anti-DLL3 antibody comprises residues 24-34 of SEQ ID NO: 405 for CDR-L1, residues 50-56 of SEQ ID NO: 405 for CDR-L2, residues 89-97 of SEQ ID NO: 405 for CDR-L3, residues 31-35 of SEQ ID NO: 407 for CDR-H1, residues 50-65 of SEQ ID NO: 407 for CDR-H2, and residues 95-102 of SEQ ID NO: 407 for CDR-H3, wherein the residues are numbered according to Kabat.

46. The antibody drug conjugate of claim 44, wherein the anti-DLL3 antibody comprises a light chain variable region comprising an amino acid sequence set forth as SEQ ID NO: 405 and a heavy chain variable region comprising an amino acid sequence set forth as SEQ ID NO: 407.

47. The antibody drug conjugate according to claim 44, wherein Ab is covalently linked to more than one PBD.

48. The antibody drug conjugate according to claim 44, wherein the ADC has a drug loading of 2.

49. The antibody drug conjugate according to claim 44, wherein 1 to 8 PBDs are covalently attached to Ab.

50. A pharmaceutical composition comprising (a) the antibody drug conjugate of claim 44, and (b) a pharmaceutically acceptable carrier.

51. The pharmaceutical composition of claim 50 comprising a drug to antibody ratio (DAR) of 1, 2, 3, 4, 5, 6, 7 or 8 each +/−0.4.

52. The pharmaceutical composition of claim 51 comprising a DAR of 2+/−0.4.

53. The pharmaceutical composition of claim 52 comprising less than 30% of non-predominant ADC species.

54. An antibody drug conjugate (ADC) comprising:

ADC 5

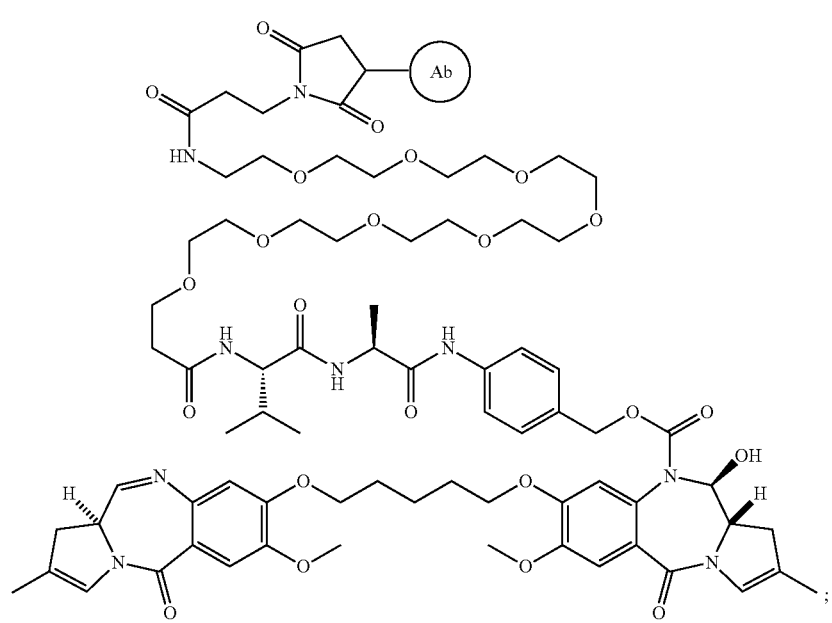

wherein Ab comprises an anti-DLL3 antibody comprising a light chain variable region comprising an amino acid sequence set forth as SEQ ID NO: 405 and a heavy chain variable region comprising an amino acid sequence set forth as SEQ ID NO: 407; and wherein the ADC has a drug loading of 2.

55. A pharmaceutical composition comprising (a) the antibody drug conjugate of claim 54, and (b) a pharmaceutically acceptable carrier.

56. The pharmaceutical composition of claim 55 comprising a DAR of 2+/−0.4.

57. The pharmaceutical composition of claim 56 comprising less than 30% of non-predominant ADC species.

58. The pharmaceutical composition of claim 55 comprising a DAR of 2+/−0.3.

59. The pharmaceutical composition of claim 58 comprising less than 30% of non-predominant ADC species.

* * * * *

UNITED STATES PATENT AND TRADEMARK OFFICE
CERTIFICATE OF CORRECTION

PATENT NO. : 9,968,687 B2
APPLICATION NO. : 14/769787
DATED : May 15, 2018
INVENTOR(S) : Michael Torgov et al.

Page 1 of 1

It is certified that error appears in the above-identified patent and that said Letters Patent is hereby corrected as shown below:

In the Claims

At Column 171, Claim 1, Lines 15-35, the text of Claim 1 should be changed to -- 1. An antibody drug conjugate (ADC) comprising an anti-DLL3 antibody covalently linked through a linker to one or more pyrrolobenzodiazepines (PBDS), wherein the one or more PBDs is/are:

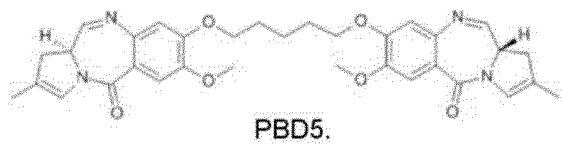

PBD5.

--

At Columns 171-174, Claim 10, Lines 44 through end of page for Column 171; Lines 42 through end of page for Column 172; Lines 1-24 for Columns 173 and 174; the text of Claim 10 should be changed to --10. The antibody drug conjugate according to claim 1, wherein the antibody drug conjugate comprises

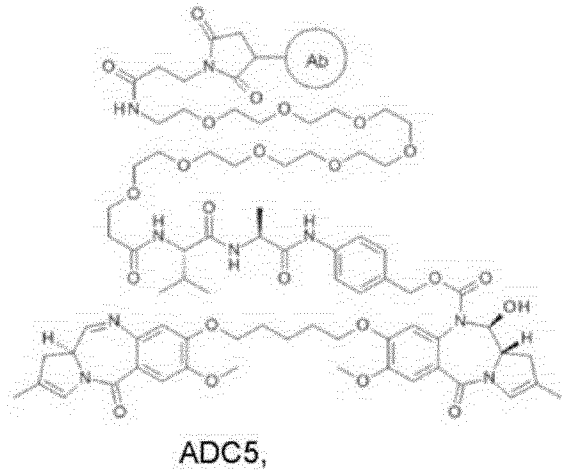

ADC5, wherein Ab comprises the anti-DLL3 antibody.--

Signed and Sealed this
Twenty-fourth Day of July, 2018

Andrei Iancu
*Director of the United States Patent and Trademark Office*